US009255154B2

(12) United States Patent
Feldhaus et al.

(10) Patent No.: US 9,255,154 B2
(45) Date of Patent: Feb. 9, 2016

(54) ANTI-PCSK9 ANTIBODIES AND USE THEREOF

(71) Applicant: ALDERBIO HOLDINGS LLC, Las Vegas, NV (US)

(72) Inventors: Andrew Lawrence Feldhaus, Lynnwood, WA (US); Leon F. Garcia-Martinez, Woodinville, WA (US); Benjamin H. Dutzar, Seattle, WA (US); Ethan Wayne Ojala, Snohomish, WA (US); Brian Robert Kovacevich, Snohomish, WA (US); Katie Olson Anderson, Kirkland, WA (US); Pei Fan, Bothell, WA (US); Jens Billgren, Seattle, WA (US); Erica Ann Stewart, Shoreline, WA (US); Corinne C. Akatsuka, Hilo, HI (US); Patricia Dianne McNeill, Federal Way, WA (US); Danielle Marie Mitchell, Seattle, WA (US); Dan Scott Allison, Lake Forrest Park, WA (US); John A. Latham, Seattle, WA (US)

(73) Assignee: ALDERBIO HOLDINGS, LLC, Las Vegas, NV (US)

( * ) Notice: Subject to any disclaimer, the term of this patent is extended or adjusted under 35 U.S.C. 154(b) by 396 days.

(21) Appl. No.: 13/795,674

(22) Filed: Mar. 12, 2013

(65) Prior Publication Data

US 2013/0302399 A1 Nov. 14, 2013

Related U.S. Application Data

(60) Provisional application No. 61/644,065, filed on May 8, 2012, provisional application No. 61/654,481, filed on Jun. 1, 2012.

(51) Int. Cl.
*C07K 16/40* (2006.01)
*A61K 39/395* (2006.01)
*A61K 45/06* (2006.01)
*A61K 39/00* (2006.01)

(52) U.S. Cl.
CPC .............. *C07K 16/40* (2013.01); *A61K 39/3955* (2013.01); *A61K 45/06* (2013.01); *A61K 2039/505* (2013.01); *C07K 2317/33* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| 7,029,895 | B2 | 4/2006 | Glucksmann |
| 7,300,754 | B2 | 11/2007 | Abi |
| 7,482,147 | B2 | 1/2009 | Glucksmann |
| 7,572,618 | B2 | 8/2009 | Mintier |
| 7,605,251 | B2 | 10/2009 | Tan |
| 7,723,342 | B2 | 5/2010 | Palani |
| 7,846,706 | B2 | 12/2010 | Mintier |
| 7,928,189 | B2 | 4/2011 | Mayne |
| 8,030,457 | B2 | 10/2011 | Jackson |
| 8,062,640 | B2 | 11/2011 | Sleeman |
| 8,080,243 | B2 | 12/2011 | Liang |
| 8,088,571 | B2 | 1/2012 | Seidah |
| 8,105,804 | B2 | 1/2012 | Mintier |
| 8,106,022 | B2 | 1/2012 | Manoharan |
| 8,143,230 | B2 | 3/2012 | Bhanot |
| 8,168,762 | B2 | 5/2012 | Jackson |
| 8,187,833 | B2 | 5/2012 | Seidah |
| 8,188,233 | B2 | 5/2012 | Condra |
| 8,188,234 | B2 | 5/2012 | Condra |
| 8,206,943 | B1 | 6/2012 | Beyer |
| 8,222,222 | B2 | 7/2012 | Tan |
| 8,227,184 | B2 | 7/2012 | Glimcher |
| 8,263,353 | B2 | 9/2012 | Sitlani |
| 8,273,869 | B2 | 9/2012 | Fitzgerald |
| 8,338,568 | B2 | 12/2012 | Seidah |
| 8,344,114 | B2 | 1/2013 | Sparrow |
| 8,354,264 | B2 | 1/2013 | Mintier |
| 8,357,371 | B2 | 1/2013 | Sleeman |
| 8,399,646 | B2 | 3/2013 | Liang |
| 8,420,098 | B2 | 4/2013 | Camphausen |
| 8,426,363 | B2 | 4/2013 | Liang |
| 8,431,544 | B1 | 4/2013 | Agrawal |
| 8,501,184 | B2 | 8/2013 | Sleeman |
| 8,507,455 | B2 | 8/2013 | Manoharan |

(Continued)

FOREIGN PATENT DOCUMENTS

| WO | WO 01/57081 | 8/2001 |
| WO | WO 2004/097047 | 11/2004 |

(Continued)

OTHER PUBLICATIONS

Chaparro-Riggers, J. et al., "Increasing Serum Half-life and Extending Cholesterol Loweing in Vivo by Engineering Antibody with pH-sensitive Binding to PCSK9", The Journal of Biological Chemistry, Mar. 30, 2012; 287(14): 11090-11097.

(Continued)

*Primary Examiner* — Sharon Wen
(74) *Attorney, Agent, or Firm* — Robin L. Teskin; LeClairRyan A Professional Corporation

(57) ABSTRACT

The present invention is directed to antibodies and fragments thereof having binding specificity for PCSK9. Another embodiment of this invention relates to the antibodies described herein, and binding fragments thereof, comprising the sequences of the $V_H$, $V_L$ and CDR polypeptides described herein, and the polynucleotides encoding them. The invention also contemplates conjugates of anti-PCSK9 antibodies and binding fragments thereof conjugated to one or more functional or detectable moieties. The invention also contemplates methods of making said anti-PCSK9 antibodies and binding fragments thereof. Embodiments of the invention also pertain to the use of anti-PCSK9 antibodies, and binding fragments thereof, for the diagnosis, assessment and treatment of diseases and disorders associated with PCSK9.

20 Claims, 130 Drawing Sheets

(56) References Cited

U.S. PATENT DOCUMENTS

| | | |
|---|---|---|
| 8,530,414 B2 | 9/2013 | Davies |
| 8,545,847 B2 | 10/2013 | Okamoto |
| 8,546,643 B2 | 10/2013 | Bentzon |
| 8,563,528 B2 | 10/2013 | Straarup |
| 8,563,698 B2 | 10/2013 | Jackson |
| 8,598,139 B2 | 12/2013 | Fitzgerald |
| 8,598,320 B2 | 12/2013 | Hedrick |
| 8,673,850 B2 | 3/2014 | Seidah |
| 8,697,070 B2 | 4/2014 | Condra |
| 8,710,192 B2 | 4/2014 | Rue |
| 8,722,082 B2 | 5/2014 | Manoharan |
| 8,742,082 B2 | 6/2014 | Tissot-Favre |
| 8,748,115 B2 | 6/2014 | Ni |
| 8,795,669 B2 | 8/2014 | Walsh |
| 8,802,827 B2 | 8/2014 | Luo |
| 8,809,292 B2 | 8/2014 | Tan |
| 8,829,165 B2 | 9/2014 | Jackson |
| 8,853,412 B2 | 10/2014 | Schwink |
| 8,859,741 B2 | 10/2014 | Jackson |
| 8,871,913 B2 | 10/2014 | Jackson |
| 8,871,914 B2 | 10/2014 | Jackson |
| 8,877,900 B2 | 11/2014 | Luo |
| 8,883,157 B1 | 11/2014 | Clube |
| 8,883,983 B2 | 11/2014 | Jackson |
| 8,889,144 B2 | 11/2014 | Champion |
| 8,889,834 B2 | 11/2014 | Jackson |
| 8,951,523 B1 | 2/2015 | Clube |
| 8,957,194 B2 | 2/2015 | Condra |
| 8,981,064 B2 | 3/2015 | Jackson |
| 8,999,341 B1 | 4/2015 | Clube |
| 9,012,498 B2 | 4/2015 | Manoharan |
| 9,023,359 B1 | 5/2015 | Clube |
| 9,029,515 B2 | 5/2015 | Pons |
| 9,034,331 B1 | 5/2015 | Clube |
| 9,034,332 B1 | 5/2015 | Clube |
| 9,040,052 B1 | 5/2015 | Clube |
| 9,045,547 B2 | 6/2015 | Jackson |
| 9,045,548 B1 | 6/2015 | Clube |
| 9,051,378 B1 | 6/2015 | Clube |
| 9,051,567 B2 | 6/2015 | Fitzgerald |
| 9,056,915 B2 | 6/2015 | Jackson |
| 9,068,012 B1 | 6/2015 | Clube |
| 9,078,823 B2 | 7/2015 | Gunderson |
| 9,080,177 B2 | 7/2015 | Saha |
| 9,089,522 B2 | 7/2015 | Zhang |
| 9,102,938 B2 | 8/2015 | Rajeev |
| 9,120,851 B2 | 9/2015 | Sleeman |
| 9,127,280 B2 | 9/2015 | Obika |
| 2004/0248177 A1 | 12/2004 | Fadel |
| 2007/0173473 A1 | 7/2007 | McSwiggen |
| 2008/0008697 A1 | 1/2008 | Mintier |
| 2008/0015162 A1 | 1/2008 | Bhanot |
| 2008/0113930 A1 | 5/2008 | Tan |
| 2008/0306015 A1 | 12/2008 | Khvorova |
| 2009/0104209 A1 | 4/2009 | Seidah |
| 2009/0130691 A1 | 5/2009 | Seidah |
| 2009/0142352 A1 | 6/2009 | Jackson |
| 2009/0232738 A1 | 9/2009 | Glimcher |
| 2009/0232795 A1 | 9/2009 | Condra |
| 2009/0239814 A1 | 9/2009 | Manoharan |
| 2009/0246192 A1 | 10/2009 | Condra |
| 2009/0247614 A1 | 10/2009 | Manoharan |
| 2009/0269350 A1 | 10/2009 | Glucksmann |
| 2009/0275053 A1 | 11/2009 | Horton |
| 2009/0275504 A1 | 11/2009 | Mayne |
| 2009/0291855 A1 | 11/2009 | Ryu |
| 2009/0306005 A1 | 12/2009 | Bhanot |
| 2009/0326202 A1 | 12/2009 | Jackson |
| 2010/0003736 A1 | 1/2010 | Mintier |
| 2010/0010066 A1 | 1/2010 | Fitzgerald |
| 2010/0040610 A1 | 2/2010 | Sitlani |
| 2010/0040611 A1 | 2/2010 | Sparrow |
| 2010/0041102 A1 | 2/2010 | Sitlani |
| 2010/0068199 A1 | 3/2010 | Liang |
| 2010/0081632 A1 | 4/2010 | Oksenberg |
| 2010/0105134 A1 | 4/2010 | Quay |
| 2010/0113575 A1 | 5/2010 | Sitlani |
| 2010/0136028 A1 | 6/2010 | Sparrow |
| 2010/0138939 A1 | 6/2010 | Bentzon |
| 2010/0150937 A1 | 6/2010 | Sparrow |
| 2010/0166768 A1 | 7/2010 | Sleeman |
| 2010/0183598 A1 | 7/2010 | Schultz |
| 2010/0216864 A1 | 8/2010 | Straarup |
| 2010/0233177 A1 | 9/2010 | Yowe |
| 2010/0291099 A1 | 11/2010 | Glucksmann |
| 2011/0003315 A1 | 1/2011 | Seidah |
| 2011/0015252 A1 | 1/2011 | Fitzgerald |
| 2011/0027287 A1 | 2/2011 | Jackson |
| 2011/0033465 A1 | 2/2011 | Hedrick |
| 2011/0039914 A1 | 2/2011 | Pavco |
| 2011/0052621 A1 | 3/2011 | Champion |
| 2011/0052669 A1 | 3/2011 | Lee |
| 2011/0054011 A1 | 3/2011 | McCullagh |
| 2011/0065644 A1 | 3/2011 | Xie |
| 2011/0065902 A1 | 3/2011 | Sleeman |
| 2011/0076742 A1 | 3/2011 | Mintier |
| 2011/0077232 A1 | 3/2011 | Monopoli |
| 2011/0117011 A1 | 5/2011 | Jackson |
| 2011/0118181 A1 | 5/2011 | Seidah |
| 2011/0136241 A1 | 6/2011 | Naylor |
| 2011/0142849 A1 | 6/2011 | Rue |
| 2011/0150875 A1 | 6/2011 | Zhang |
| 2011/0159015 A1 | 6/2011 | Sleeman |
| 2011/0172292 A1 | 7/2011 | Hansen |
| 2011/0195111 A1 | 8/2011 | Butters |
| 2011/0224280 A1 | 9/2011 | Nielsen |
| 2011/0229489 A1 | 9/2011 | Pons |
| 2011/0230392 A1 | 9/2011 | Chiang |
| 2011/0230542 A1 | 9/2011 | Tan |
| 2011/0256148 A1 | 10/2011 | Sleeman |
| 2011/0306060 A1 | 12/2011 | Ni |
| 2011/0311582 A1 | 12/2011 | Manoharan |
| 2011/0311583 A1 | 12/2011 | Manoharan |
| 2011/0313024 A1 | 12/2011 | Beigelman |
| 2012/0004289 A1 | 1/2012 | Song |
| 2012/0014951 A1 | 1/2012 | Liang |
| 2012/0015435 A1 | 1/2012 | Liang |
| 2012/0016009 A1 | 1/2012 | Fitzgerald |
| 2012/0020975 A1 | 1/2012 | Jackson |
| 2012/0020976 A1 | 1/2012 | Jackson |
| 2012/0027765 A1 | 2/2012 | Jackson |
| 2012/0027796 A1 | 2/2012 | Manoharan |
| 2012/0027803 A1 | 2/2012 | Manoharan |
| 2012/0046478 A1 | 2/2012 | Manoharan |
| 2012/0058144 A1 | 3/2012 | Manoharan |
| 2012/0076799 A1 | 3/2012 | Sparrow |
| 2012/0077964 A1 | 3/2012 | Sparrow |
| 2012/0082679 A1 | 4/2012 | Sparrow |
| 2012/0082680 A1 | 4/2012 | Sitlani |
| 2012/0093818 A1 | 4/2012 | Jackson |
| 2012/0093922 A1 | 4/2012 | Manku |
| 2012/0094909 A1 | 4/2012 | Camphausen |
| 2012/0101148 A1 | 4/2012 | Aking |
| 2012/0121698 A1 | 5/2012 | Manku |
| 2012/0122954 A1 | 5/2012 | Straarup |
| 2012/0128679 A1 | 5/2012 | Okamoto |
| 2012/0129237 A1 | 5/2012 | Mintier |
| 2012/0136042 A1 | 5/2012 | Manoharan |
| 2012/0142101 A1 | 6/2012 | Manoharan |
| 2012/0157511 A1 | 6/2012 | Manoharan |
| 2012/0157513 A1 | 6/2012 | Li |
| 2012/0178643 A1 | 7/2012 | Ault-Riche |
| 2012/0195910 A1 | 8/2012 | Wu |
| 2012/0208208 A1 | 8/2012 | Ni |
| 2012/0208209 A1 | 8/2012 | Ichetovkin |
| 2012/0213794 A1 | 8/2012 | Luo |
| 2012/0213797 A1 | 8/2012 | Jackson |
| 2012/0214181 A1 | 8/2012 | Beyer |
| 2012/0219558 A1 | 8/2012 | Ni |
| 2012/0231005 A1 | 9/2012 | Luo |
| 2012/0237945 A1 | 9/2012 | Seidah |
| 2012/0244207 A1 | 9/2012 | Fitzgerald |
| 2012/0251544 A1 | 10/2012 | Jackson |
| 2012/0252796 A1 | 10/2012 | Pingali |

(56) References Cited

U.S. PATENT DOCUMENTS

| | | |
|---|---|---|
| 2012/0258183 A1 | 10/2012 | Smith |
| 2012/0270929 A1 | 10/2012 | Crooke |
| 2012/0301461 A1 | 11/2012 | Condra |
| 2013/0011922 A1 | 1/2013 | Quay |
| 2013/0017223 A1 | 1/2013 | Hope |
| 2013/0035371 A1 | 2/2013 | Fitzgerald |
| 2013/0052201 A1 | 2/2013 | Jackson |
| 2013/0058944 A1 | 3/2013 | Jackson |
| 2013/0064825 A1 | 3/2013 | Chan |
| 2013/0064834 A1 | 3/2013 | Sleeman |
| 2013/0071379 A1 | 3/2013 | Condra |
| 2013/0071405 A1 | 3/2013 | Davies |
| 2013/0072665 A1 | 3/2013 | Jackson |
| 2013/0079501 A1 | 3/2013 | Jackson |
| 2013/0079502 A1 | 3/2013 | Jackson |
| 2013/0085265 A1 | 4/2013 | Jackson |
| 2013/0085266 A1 | 4/2013 | Sleeman |
| 2013/0096181 A1 | 4/2013 | Ashkenazi |
| 2013/0108612 A1 | 5/2013 | Mintier |
| 2013/0115223 A1 | 5/2013 | Sparrow |
| 2013/0129785 A1 | 5/2013 | Manoharan |
| 2013/0130378 A1 | 5/2013 | Manoharan |
| 2013/0171149 A1 | 7/2013 | Sleeman |
| 2013/0172402 A1 | 7/2013 | Obika |
| 2013/0178512 A1 | 7/2013 | Manoharan |
| 2013/0184324 A1 | 7/2013 | Fitzgerald |
| 2013/0189277 A1 | 7/2013 | Walsh |
| 2013/0189278 A1 | 7/2013 | Sitlani |
| 2013/0195879 A1 | 8/2013 | Bylock |
| 2013/0197055 A1 | 8/2013 | Kamens |
| 2013/0202652 A1 | 8/2013 | Manoharan |
| 2013/0203836 A1 | 8/2013 | Rajeev |
| 2013/0210703 A1 | 8/2013 | Camphausen |
| 2013/0225814 A1 | 8/2013 | Ohgiya |
| 2013/0236468 A1 | 9/2013 | Bylock |
| 2013/0243784 A1 | 9/2013 | Swergold |
| 2013/0245235 A1 | 9/2013 | Jackson |
| 2013/0252987 A1 | 9/2013 | Rashid |
| 2013/0266574 A1 | 10/2013 | Sleeman |
| 2013/0273069 A1 | 10/2013 | Liang |
| 2013/0273081 A1 | 10/2013 | Monaci |
| 2013/0289094 A1 | 10/2013 | Hinkle |
| 2013/0302399 A1 | 11/2013 | Feldhaus |
| 2013/0315927 A1 | 11/2013 | Goldstein |
| 2013/0323269 A1 | 12/2013 | Manoharan |
| 2013/0323836 A1 | 12/2013 | Manoharan |
| 2013/0331430 A1 | 12/2013 | Tan |
| 2013/0344085 A1 | 12/2013 | Wu |
| 2013/0344133 A1 | 12/2013 | Pachuk |
| 2013/0344512 A1 | 12/2013 | Aste-Amezaga |
| 2014/0004122 A1 | 1/2014 | Chan |
| 2014/0004142 A1 | 1/2014 | Champion |
| 2014/0011236 A1 | 1/2014 | Davidson |
| 2014/0017329 A1 | 1/2014 | Mousa |
| 2014/0030270 A1 | 1/2014 | Clogston |
| 2014/0030760 A1 | 1/2014 | Saha |
| 2014/0044730 A1 | 2/2014 | Yancopoulos |
| 2014/0045919 A1 | 2/2014 | Manoharan |
| 2014/0065649 A1 | 3/2014 | Schaefer |
| 2014/0093513 A1 | 4/2014 | Milne |
| 2014/0099312 A1 | 4/2014 | Sleeman |
| 2014/0099333 A1 | 4/2014 | Schwink |
| 2014/0100156 A1 | 4/2014 | Haack |
| 2014/0120091 A1 | 5/2014 | Ledbetter |
| 2014/0121263 A1 | 5/2014 | Fitzgerald |
| 2014/0154262 A1 | 6/2014 | Hanotin |
| 2014/0155468 A1 | 6/2014 | Gregory |
| 2014/0161798 A1 | 6/2014 | Hedrick |
| 2014/0161808 A1 | 6/2014 | Mintier |
| 2014/0161820 A1 | 6/2014 | Hellstrom |
| 2014/0161821 A1 | 6/2014 | Udata |
| 2014/0178402 A1 | 6/2014 | Hanotin |
| 2014/0194512 A1 | 7/2014 | Fawzy |
| 2014/0200257 A1 | 7/2014 | Rajeev |
| 2014/0206608 A1 | 7/2014 | Haack |
| 2014/0206609 A1 | 7/2014 | Haack |
| 2014/0212431 A1 | 7/2014 | Kirchhofer |
| 2014/0213513 A1 | 7/2014 | Haack |
| 2014/0220027 A1 | 8/2014 | Condra |
| 2014/0221281 A1 | 8/2014 | Haack |
| 2014/0228253 A1 | 8/2014 | Tissot-Favre |
| 2014/0228545 A1 | 8/2014 | Jackson |
| 2014/0228547 A1 | 8/2014 | Jackson |
| 2014/0228557 A1 | 8/2014 | Jackson |
| 2014/0235830 A1 | 8/2014 | Jackson |
| 2014/0235831 A1 | 8/2014 | Jackson |
| 2014/0275211 A1 | 9/2014 | Sah |
| 2014/0287459 A1 | 9/2014 | Lesnicki |
| 2014/0287952 A1 | 9/2014 | Allison |
| 2014/0288008 A1 | 9/2014 | Matschiner |
| 2014/0288272 A1 | 9/2014 | Allison |
| 2014/0288511 A1 | 9/2014 | Tan-Malecki |
| 2014/0308304 A1 | 10/2014 | Manoharan |
| 2014/0315928 A1 | 10/2014 | Darout |
| 2014/0324460 A1 | 10/2014 | Caffrey |
| 2014/0341928 A1 | 11/2014 | Walsh |
| 2014/0350075 A1 | 11/2014 | Tan |
| 2014/0356370 A1 | 12/2014 | Swergold |
| 2014/0356371 A1 | 12/2014 | Swergold |
| 2014/0357850 A1 | 12/2014 | Jackson |
| 2014/0357851 A1 | 12/2014 | Jackson |
| 2014/0357852 A1 | 12/2014 | Jackson |
| 2014/0357853 A1 | 12/2014 | Jackson |
| 2014/0357854 A1 | 12/2014 | Jackson |
| 2015/0004174 A1 | 1/2015 | Wasserman |
| 2015/0005363 A1 | 1/2015 | Ansell |
| 2015/0005372 A1 | 1/2015 | Hoge |
| 2015/0005386 A1 | 1/2015 | Bisgaier |
| 2015/0017183 A1 | 1/2015 | Seidah |
| 2015/0023924 A1 | 1/2015 | High |
| 2015/0031870 A1 | 1/2015 | Jackson |
| 2015/0037816 A1 | 2/2015 | Yeh |
| 2015/0071951 A1 | 3/2015 | Brunner |
| 2015/0080457 A1 | 3/2015 | Manoharan |
| 2015/0080463 A1 | 3/2015 | Muntendam |
| 2015/0087585 A1 | 3/2015 | Ahn |
| 2015/0087819 A1 | 3/2015 | Jackson |
| 2015/0098957 A1 | 4/2015 | Champion |
| 2015/0111955 A1 | 4/2015 | High |
| 2015/0119444 A1 | 4/2015 | Manoharan |
| 2015/0133531 A1 | 5/2015 | Wiegand |
| 2015/0139987 A1 | 5/2015 | Martin |
| 2015/0140002 A1 | 5/2015 | Baccara-Dinet |
| 2015/0140005 A1 | 5/2015 | Walley |
| 2015/0152191 A1 | 6/2015 | Baccara-Dinet |
| 2015/0157685 A1 | 6/2015 | Wilson |
| 2015/0160247 A1 | 6/2015 | Laaksonen |
| 2015/0164995 A1 | 6/2015 | Kadereit |
| 2015/0164996 A1 | 6/2015 | Kadereit |
| 2015/0164997 A1 | 6/2015 | Haack |
| 2015/0166625 A1 | 6/2015 | Haack |
| 2015/0166627 A1 | 6/2015 | Kadereit |
| 2015/0166672 A1 | 6/2015 | Clube |
| 2015/0166673 A1 | 6/2015 | Clube |
| 2015/0166677 A1 | 6/2015 | Clube |
| 2015/0167005 A1 | 6/2015 | Freier |
| 2015/0190369 A1 | 7/2015 | Mbikay |
| 2015/0197564 A1 | 7/2015 | Sleeman |
| 2015/0216855 A1 | 8/2015 | Nagiec |
| 2015/0231236 A1 | 8/2015 | Pordy |

FOREIGN PATENT DOCUMENTS

| | | |
|---|---|---|
| WO | WO 2008/057457 | 5/2008 |
| WO | WO 2008/057458 | 5/2008 |
| WO | WO 2008/057459 | 5/2008 |
| WO | WO 2008/063382 | 5/2008 |
| WO | WO 2008/105797 | 9/2008 |
| WO | WO 2008/109871 | 9/2008 |
| WO | WO 2008/125623 | 10/2008 |
| WO | WO 2008/133647 | 11/2008 |
| WO | WO 2009/026558 | 2/2009 |
| WO | WO 2009/055783 | 4/2009 |
| WO | WO 2009/100297 | 8/2009 |

(56) References Cited

FOREIGN PATENT DOCUMENTS

| WO | WO 2009/100318 | 8/2009 |
| WO | WO 2009/131740 | 10/2009 |
| WO | WO 2010/029513 | 3/2010 |
| WO | WO 2010/077854 | 7/2010 |
| WO | WO 2011/037791 | 3/2011 |
| WO | WO 2011/072263 | 6/2011 |
| WO | WO 2011/111007 | 9/2011 |
| WO | WO 2012/088313 | 6/2012 |

OTHER PUBLICATIONS

Liang, H. et al., "Proprotein Convertase Substilisin/Kexin Type 9 Antagonism Reduces Low-Density Lipoprotein Cholesterol in Statin-Treated Hypercholesterolemic Nonhuman Primates", The Journal of Pharmacology and Experimental Therapeutics, 2012; 340(2): 228-236.

Ni, Y. et al., "A PCSK9-binding antibody that structurally mimics the EGF(A) domain of LDL-receptor reduces LDL cholesterol in vivo", Journal of Lipid Research, 2011; 52: 78-86.

Ni, Y. et al., "A Proprotein Convertase Subtilisin-like/Kinexin Type 9 (PCSK9) C-terminal Domain Antibody Antigen-binding Fragment Inhibits PCSK9 Internalization and Restores Low Density Lipoprotein Uptake", The Journal of Biological Chemistry, Apr. 23, 2010; 285(17): 12882-12891.

Zhang, L. et al., "An Anti-PCSK9 Antibody Reduces LDL-Cholesterol on Top of a Statin and Suppresses Hepatocyte SREBP-Regulated Genes", International Journal of Biological Sciences, Feb. 9, 2012; 8(3): 310-327.

Chilewski, SD et al. "Validation of preclinical pharmacokinetic and immunogenicity assays for an anti-PCSK9 antibody," J Immunoassay Immunochem. 2011;32(4):296-317.

Swergold, G et al. "Safety. Lipid, and Lipoprotein Effects of REGN727/SAR236553, a Fully-Human Proprotein Convertase Subtilisin Kexin 9 (PCSK9) Monoclonal Antibody Administered Intravenously to Healthy Volunteers," Circulation: Scientific Sessions of the American-Heart-Association on Resuscitation Science Symposium; vol. 122, No. 21, Suppl. S, Nov. 1, 2010.

Dias C et al."Abstract 18781: A Phase 1, Randomized, Double-Blind, Placebo-Controlled, Ascending Single Dose Study to Evaluate the Safety, Tolerability and Pharmacodynamics of AMG145", Circulation: Scientific Sessions of the American-Heart-Association on Resuscitation Science Symposium, vol. 124, No. 21, Suppl. S, Nov. 2011.

Figure 1A
Antibody Heavy chain Protein features

| Sequence Name | FR1 | CDR1 | FR2 | CDR2 |
|---|---|---|---|---|
| Ab1 | QSVEESGGRLVTPGTPLTLTCTVSGFSLS | SYWMT | WVRQAPGKGLEYIG | IISSSGSTYYATWAKG |
| Ab2 | QSVEESGGRLVTPGTPLTLTCTVSGFSLS | SYAMS | WVRQAPGKGLEWIG | IIDAIDNTYYASWAKG |
| Ab3 | QSVEESGGRLVTPGSLTLTCTASGFSLS | SYYMS | WVRQAPGKGLEWIG | IIYPSGSTYYASWAKG |
| Ab4 | QSVEESGGRLVTPGTPLTLTCTVSGIDLS | SYAMI | WVRQAPEKGLEYIG | YIGGIDSTYYASWAKG |
| Ab5 | QSVEESGGRLVTPGTPLTLTCTVSGFSLS | SYAMS | WVRQAPEKGLEYIG | IISNSGTTYYASWAKG |
| Ab6 | QEQLEESGGDLVKPEGSLTLTCTASGFSFS | SNYWIC | WVRQAPGKGLEWIG | CIRDGGGTYYASWAKG |
| Ab7 | EVQLVESGGGLVQPGGSLRLSCAASGFTVS | SNYWIC | WVRQAPGKGLEWIG | CIRDGGGTYYASSAKG |
| Ab8 | QEQLVESGGGLVQPGGSLTLTCTASGFSFT | SDYYMC | WVRQAPGKGLEWIG | CISTGDGSTYYASWAKG |
| Ab9 | QSVEESGGRLVTPGTPLTLTCTVSGIDLS | SYAMG | WVRQAPGKGLEYIG | IIVSYGPTYYASWAKG |
| Ab10 | QEQLEESGGDLVKPEGSLTLTCTASGFSFS | SSYWIC | WVRQAPGKGLEWIA | CIRAGGGNYYANWAKG |
| Ab11 | EVQLVESGGGLVQPGGSLRLSCAASGFTVS | SSYWIC | WVRQAPGKGLEWIA | CIRAGGGNYYANSAKG |
| Ab12 | EVQLVESGGGLVQPGGSLRLSCAASGFTVS | SSYWIC | WVRQAPGKGLEWIA | CIRAGGGNYYANSAKG |
| Ab13 | QSVEESGGRLVTPGTPLTLTCTVSGIDLS | TYGVG | WVRQAPGKGLEYIG | IISSSGSTYYASWAKG |
| Ab14 | QEQLEESGGDLVKPEGSLTLTCTGSGFSFS | SIAYMC | WIRQAPGKGLEWIG | CIGSGSGNTYYANWAKG |
| Ab15 | QEQLEESGGDLVKPEGSLTLTCTASGFSFS | SSYWIC | WVRQAPGKGLEWIA | CIDAGNSGSTYYASWAKG |
| Ab16 | QEQLVESGGGLVQPEGSLTLTCTASGFSFS | SDYWIC | WVRQAPGKGLEWIG | CIRDGGGSYYANWAKG |
| Ab17 | QEQLEESGGDLVKPEGSLTLTCTASGFSFS | SSYWIC | WVRQAPGKGLEWIG | CIRPGSADYYASWAKG |
| Ab18 | EVQLVESGGGLVQPGGSLRLSCAASGFTVS | SNYWIC | WVRQAPGKGLEWIG | CIRDGGGTYYASSAKG |
| Ab19 | EVQLVESGGGLVQPGGSLRLSCAASGIDLS | SYAMG | WVRQAPGKGLEYIG | IIVSYGPTYYASWAKG |
| Ab20 | EVQLVESGGGLVQPGGSLRLSCAASGIDLS | SYAMG | WVRQAPGKGLEYIG | IIVSYGPTYYASWAKG |
| Ab21 | QSVEESGGRLVTPGTPLTLTCTVSGFSLS | SYAMN | WVRQAPGKGLEWIG | AIRSSGATFFASWVNG |
| Ab22 | EVQLVESGGGLVQPGGSLRLSCAASGFSLS | SYAMN | WVRQAPGKGLEWIG | AIRSSGATFFASSVNG |
| Ab23 | QSLEESGGDLVKPGASLTLTCKASGFSFS | SGYYMC | WVRQAPGKGLEWIA | CIYAGSGGSTFFANWAKG |
| Ab24 | QSLEESGGDLVKPGASLTLTCKASGFSFS | SGYYMC | WVRQAPGKGLEWIA | CIYAGSGGSTFFANWAKG |

Figure 1B
Antibody Heavy chain Protein features

| Sequence Name | FR3 | CDR3 | FR4 |
|---|---|---|---|
| Ab1 | RFTISKTSSTTVDLEITSPTTEDTATYFCAR | DSAFSSGLEFNI | WGPGTLVTVSS |
| Ab2 | RFTISKTSTTVDLKMTSLTTGDTATYFCAR | ASILGYSIATGFNI | WGPGTLVTVSS |
| Ab3 | RFTISKTSTTVDLKITSPTVEDTATYFCAR | GGAYATLNL | WGPGTLVTVSS |
| Ab4 | RFTISKTSTTVDLKMTSPTTEDTATYFCGR | WSGTSGYNTI | WGPGTLVTVSS |
| Ab5 | RFTISKTSTTVDLKITSPTTEDTATYFCAR | GIYWYWRVFNL | WGPGTLVTVSS |
| Ab6 | RLTISMTSSTTVTLQLNSLTAADTATYFCAS | DINDGWLGQFNL | WGPGTLVTVSS |
| Ab7 | RFTISRDNSKNTLYLQMNSLRAEDTAVYYCAS | DINDGWLGQFNL | WGQGTLVTVSS |
| Ab8 | RFTISKPSSTTVTLQMTRLTAADTATYFCAR | DRYYSYAYGAYVYASDL | WGPGTLVTVSS |
| Ab9 | RFTISKTSTTVDLKITSPTAEDTATYFCAR | DLDANSSGYYGCFNI | WGQGTLVTVSS |
| Ab10 | RFTISRTSSTTVTLQMTSLTAADTATYFCAS | DINDGWLGQFNL | WGPGTLVTVSS |
| Ab11 | RFTISRDNSKNTLYLQMNSLRAEDTAVYYCAS | DINDGWLGQFNL | WGQGTLVTVSS |
| Ab12 | RFTISRDNSKNTLYLQMNSLRAEDTAVYYCAS | DINDGWLGQFNL | WGQGTLVTVSS |
| Ab13 | RFTISKTSSTTVTLQMTSLTTEDTATYFCAR | DWSSTTGYYGYFNM | WGPGTLVTVSS |
| Ab14 | RFTISKSSSTTVTLQMTSLTAADTATYFCAS | DTNNGWLGQFNL | WGQGTLVTVSS |
| Ab15 | RFTISKASSTTVTLQMTSLTAADTATYFCAS | DLNDGWLGQFNL | WGPGTLVTVSS |
| Ab16 | RLTISMTSSTTVGLKMTSLTAADTATYFCAS | DINDGWLGQFNL | WGPGTLVTVSS |
| Ab17 | RFTISRASSSTVTLQMTSLTAADTAVYYCAS | DINDGWLGQFNL | WGQGTLVTVSS |
| Ab18 | RFTISRDNSKNTLYLQMNSLRAEDTAVYYCAS | DINDGWLGQFNL | WGPGTLVTVSS |
| Ab19 | RFTISRDNSKNTLYLQMNSLRAEDTATYFCAR | DLDAQSSGYYGAFNI | WGQGTLVTVSS |
| Ab20 | RFTISRDNSKSTVYLQMNSLRAEDTATYFCAR | DLDAQSSGYYGAFNI | WGQGTLVTVSS |
| Ab21 | RFTISKTSTTVDLKITSPTPEDTATYFCAR | DTNDGWYINRLDL | WGPGTLVTVSS |
| Ab22 | RFTISRDNSKNTVYLQMNSLRAEDTAVYYCAR | DTNDGWYINRLDL | WGQGTLVTVSS |
| Ab23 | RFTISKTSSTTVTLQMTSLTAADTATYFCAR | DGGYAGYGYAFFNL | WGPGTLVTVSS |
| Ab24 | RFTISKTSSTTVTLQMTSLTAADTATYFCAR | DGGYAGYGYAFFNL | WGPGTLVTVSS |

Figure 1C
Antibody Heavy chain Protein features

| Sequence Name | Constant region |
|---|---|
| Ab1 | ASTKGPSVFPLAPSSKSTSGGTAALGCLVKDYFPEPVTVSWNSGALTSGVHTFPAVLQSSGLYSLSSVVTVPSSSL |
| Ab2 | ASTKGPSVFPLAPSSKSTSGGTAALGCLVKDYFPEPVTVSWNSGALTSGVHTFPAVLQSSGLYSLSSVVTVPSSSL |
| Ab3 | ASTKGPSVFPLAPSSKSTSGGTAALGCLVKDYFPEPVTVSWNSGALTSGVHTFPAVLQSSGLYSLSSVVTVPSSSL |
| Ab4 | ASTKGPSVFPLAPSSKSTSGGTAALGCLVKDYFPEPVTVSWNSGALTSGVHTFPAVLQSSGLYSLSSVVTVPSSSL |
| Ab5 | ASTKGPSVFPLAPSSKSTSGGTAALGCLVKDYFPEPVTVSWNSGALTSGVHTFPAVLQSSGLYSLSSVVTVPSSSL |
| Ab6 | ASTKGPSVFPLAPSSKSTSGGTAALGCLVKDYFPEPVTVSWNSGALTSGVHTFPAVLQSSGLYSLSSVVTVPSSSL |
| Ab7 | ASTKGPSVFPLAPSSKSTSGGTAALGCLVKDYFPEPVTVSWNSGALTSGVHTFPAVLQSSGLYSLSSVVTVPSSSL |
| Ab8 | ASTKGPSVFPLAPSSKSTSGGTAALGCLVKDYFPEPVTVSWNSGALTSGVHTFPAVLQSSGLYSLSSVVTVPSSSL |
| Ab9 | ASTKGPSVFPLAPSSKSTSGGTAALGCLVKDYFPEPVTVSWNSGALTSGVHTFPAVLQSSGLYSLSSVVTVPSSSL |
| Ab10 | ASTKGPSVFPLAPSSKSTSGGTAALGCLVKDYFPEPVTVSWNSGALTSGVHTFPAVLQSSGLYSLSSVVTVPSSSL |
| Ab11 | ASTKGPSVFPLAPSSKSTSGGTAALGCLVKDYFPEPVTVSWNSGALTSGVHTFPAVLQSSGLYSLSSVVTVPSSSL |
| Ab12 | ASTKGPSVFPLAPSSKSTSGGTAALGCLVKDYFPEPVTVSWNSGALTSGVHTFPAVLQSSGLYSLSSVVTVPSSSL |
| Ab13 | ASTKGPSVFPLAPSSKSTSGGTAALGCLVKDYFPEPVTVSWNSGALTSGVHTFPAVLQSSGLYSLSSVVTVPSSSL |
| Ab14 | ASTKGPSVFPLAPSSKSTSGGTAALGCLVKDYFPEPVTVSWNSGALTSGVHTFPAVLQSSGLYSLSSVVTVPSSSL |
| Ab15 | ASTKGPSVFPLAPSSKSTSGGTAALGCLVKDYFPEPVTVSWNSGALTSGVHTFPAVLQSSGLYSLSSVVTVPSSSL |
| Ab16 | ASTKGPSVFPLAPSSKSTSGGTAALGCLVKDYFPEPVTVSWNSGALTSGVHTFPAVLQSSGLYSLSSVVTVPSSSL |
| Ab17 | ASTKGPSVFPLAPSSKSTSGGTAALGCLVKDYFPEPVTVSWNSGALTSGVHTFPAVLQSSGLYSLSSVVTVPSSSL |
| Ab18 | ASTKGPSVFPLAPSSKSTSGGTAALGCLVKDYFPEPVTVSWNSGALTSGVHTFPAVLQSSGLYSLSSVVTVPSSSL |
| Ab19 | ASTKGPSVFPLAPSSKSTSGGTAALGCLVKDYFPEPVTVSWNSGALTSGVHTFPAVLQSSGLYSLSSVVTVPSSSL |
| Ab20 | ASTKGPSVFPLAPSSKSTSGGTAALGCLVKDYFPEPVTVSWNSGALTSGVHTFPAVLQSSGLYSLSSVVTVPSSSL |
| Ab21 | ASTKGPSVFPLAPSSKSTSGGTAALGCLVKDYFPEPVTVSWNSGALTSGVHTFPAVLQSSGLYSLSSVVTVPSSSL |
| Ab22 | ASTKGPSVFPLAPSSKSTSGGTAALGCLVKDYFPEPVTVSWNSGALTSGVHTFPAVLQSSGLYSLSSVVTVPSSSL |
| Ab23 | ASTKGPSVFPLAPSSKSTSGGTAALGCLVKDYFPEPVTVSWNSGALTSGVHTFPAVLQSSGLYSLSSVVTVPSSSL |
| Ab24 | ASTKGPSVFPLAPSSKSTSGGTAALGCLVKDYFPEPVTVSWNSGALTSGVHTFPAVLQSSGLYSLSSVVTVPSSSL |

Figure 1D
Antibody Heavy chain Protein features

| Sequence Name | Constant region |
|---|---|
| Ab1 | GTQTYICNVNHKPSNTKVDKRVEPKSCDKTHTCPPCPAPELLGGPSVFLFPPKPKDTLMISRTPEVTCVVVDVSH |
| Ab2 | GTQTYICNVNHKPSNTKVDKRVEPKSCDKTHTCPPCPAPELLGGPSVFLFPPKPKDTLMISRTPEVTCVVVDVSH |
| Ab3 | GTQTYICNVNHKPSNTKVDKRVEPKSCDKTHTCPPCPAPELLGGPSVFLFPPKPKDTLMISRTPEVTCVVVDVSH |
| Ab4 | GTQTYICNVNHKPSNTKVDKRVEPKSCDKTHTCPPCPAPELLGGPSVFLFPPKPKDTLMISRTPEVTCVVVDVSH |
| Ab5 | GTQTYICNVNHKPSNTKVDKRVEPKSCDKTHTCPPCPAPELLGGPSVFLFPPKPKDTLMISRTPEVTCVVVDVSH |
| Ab6 | GTQTYICNVNHKPSNTKVDKRVEPKSCDKTHTCPPCPAPELLGGPSVFLFPPKPKDTLMISRTPEVTCVVVDVSH |
| Ab7 | GTQTYICNVNHKPSNTKVDKRVEPKSCDKTHTCPPCPAPELLGGPSVFLFPPKPKDTLMISRTPEVTCVVVDVSH |
| Ab8 | GTQTYICNVNHKPSNTKVDKRVEPKSCDKTHTCPPCPAPELLGGPSVFLFPPKPKDTLMISRTPEVTCVVVDVSH |
| Ab9 | GTQTYICNVNHKPSNTKVDKRVEPKSCDKTHTCPPCPAPELLGGPSVFLFPPKPKDTLMISRTPEVTCVVVDVSH |
| Ab10 | GTQTYICNVNHKPSNTKVDKRVEPKSCDKTHTCPPCPAPELLGGPSVFLFPPKPKDTLMISRTPEVTCVVVDVSH |
| Ab11 | GTQTYICNVNHKPSNTKVDKRVEPKSCDKTHTCPPCPAPELLGGPSVFLFPPKPKDTLMISRTPEVTCVVVDVSH |
| Ab12 | GTQTYICNVNHKPSNTKVDKRVEPKSCDKTHTCPPCPAPELLGGPSVFLFPPKPKDTLMISRTPEVTCVVVDVSH |
| Ab13 | GTQTYICNVNHKPSNTKVDKRVEPKSCDKTHTCPPCPAPELLGGPSVFLFPPKPKDTLMISRTPEVTCVVVDVSH |
| Ab14 | GTQTYICNVNHKPSNTKVDKRVEPKSCDKTHTCPPCPAPELLGGPSVFLFPPKPKDTLMISRTPEVTCVVVDVSH |
| Ab15 | GTQTYICNVNHKPSNTKVDKRVEPKSCDKTHTCPPCPAPELLGGPSVFLFPPKPKDTLMISRTPEVTCVVVDVSH |
| Ab16 | GTQTYICNVNHKPSNTKVDKRVEPKSCDKTHTCPPCPAPELLGGPSVFLFPPKPKDTLMISRTPEVTCVVVDVSH |
| Ab17 | GTQTYICNVNHKPSNTKVDKRVEPKSCDKTHTCPPCPAPELLGGPSVFLFPPKPKDTLMISRTPEVTCVVVDVSH |
| Ab18 | GTQTYICNVNHKPSNTKVDARVEPKSCDKTHTCPPCPAPELLGGPSVFLFPPKPKDTLMISRTPEVTCVVVDVSH |
| Ab19 | GTQTYICNVNHKPSNTKVDKRVEPKSCDKTHTCPPCPAPELLGGPSVFLFPPKPKDTLMISRTPEVTCVVVDVSH |
| Ab20 | GTQTYICNVNHKPSNTKVDKRVEPKSCDKTHTCPPCPAPELLGGPSVFLFPPKPKDTLMISRTPEVTCVVVDVSH |
| Ab21 | GTQTYICNVNHKPSNTKVDARVEPKSCDKTHTCPPCPAPELLGGPSVFLFPPKPKDTLMISRTPEVTCVVVDVSH |
| Ab22 | GTQTYICNVNHKPSNTKVDKRVEPKSCDKTHTCPPCPAPELLGGPSVFLFPPKPKDTLMISRTPEVTCVVVDVSH |
| Ab23 | GTQTYICNVNHKPSNTKVDKRVEPKSCDKTHTCPPCPAPELLGGPSVFLFPPKPKDTLMISRTPEVTCVVVDVSH |
| Ab24 | GTQTYICNVNHKPSNTKVDKRVEPKSCDKTHTCPPCPAPELLGGPSVFLFPPKPKDTLMISRTPEVTCVVVDVSH |

Figure 1E
Antibody Heavy chain Protein features

| Sequence Name | Constant region |
|---|---|
| Ab1 | EDPEVKFNWYVDGVEVHNAKTKPREEQYASTYRVVSVLTVLHQDWLNGKEYKCKVSNKALPAPIEKTISKAKGQP |
| Ab2 | EDPEVKFNWYVDGVEVHNAKTKPREEQYASTYRVVSVLTVLHQDWLNGKEYKCKVSNKALPAPIEKTISKAKGQP |
| Ab3 | EDPEVKFNWYVDGVEVHNAKTKPREEQYASTYRVVSVLTVLHQDWLNGKEYKCKVSNKALPAPIEKTISKAKGQP |
| Ab4 | EDPEVKFNWYVDGVEVHNAKTKPREEQYASTYRVVSVLTVLHQDWLNGKEYKCKVSNKALPAPIEKTISKAKGQP |
| Ab5 | EDPEVKFNWYVDGVEVHNAKTKPREEQYASTYRVVSVLTVLHQDWLNGKEYKCKVSNKALPAPIEKTISKAKGQP |
| Ab6 | EDPEVKFNWYVDGVEVHNAKTKPREEQYASTYRVVSVLTVLHQDWLNGKEYKCKVSNKALPAPIEKTISKAKGQP |
| Ab7 | EDPEVKFNWYVDGVEVHNAKTKPREEQYASTYRVVSVLTVLHQDWLNGKEYKCKVSNKALPAPIEKTISKAKGQP |
| Ab8 | EDPEVKFNWYVDGVEVHNAKTKPREEQYASTYRVVSVLTVLHQDWLNGKEYKCKVSNKALPAPIEKTISKAKGQP |
| Ab9 | EDPEVKFNWYVDGVEVHNAKTKPREEQYASTYRVVSVLTVLHQDWLNGKEYKCKVSNKALPAPIEKTISKAKGQP |
| Ab10 | EDPEVKFNWYVDGVEVHNAKTKPREEQYASTYRVVSVLTVLHQDWLNGKEYKCKVSNKALPAPIEKTISKAKGQP |
| Ab11 | EDPEVKFNWYVDGVEVHNAKTKPREEQYASTYRVVSVLTVLHQDWLNGKEYKCKVSNKALPAPIEKTISKAKGQP |
| Ab12 | EDPEVKFNWYVDGVEVHNAKTKPREEQYASTYRVVSVLTVLHQDWLNGKEYKCKVSNKALPAPIEKTISKAKGQP |
| Ab13 | EDPEVKFNWYVDGVEVHNAKTKPREEQYASTYRVVSVLTVLHQDWLNGKEYKCKVSNKALPAPIEKTISKAKGQP |
| Ab14 | EDPEVKFNWYVDGVEVHNAKTKPREEQYASTYRVVSVLTVLHQDWLNGKEYKCKVSNKALPAPIEKTISKAKGQP |
| Ab15 | EDPEVKFNWYVDGVEVHNAKTKPREEQYASTYRVVSVLTVLHQDWLNGKEYKCKVSNKALPAPIEKTISKAKGQP |
| Ab16 | EDPEVKFNWYVDGVEVHNAKTKPREEQYASTYRVVSVLTVLHQDWLNGKEYKCKVSNKALPAPIEKTISKAKGQP |
| Ab17 | EDPEVKFNWYVDGVEVHNAKTKPREEQYASTYRVVSVLTVLHQDWLNGKEYKCKVSNKALPAPIEKTISKAKGQP |
| Ab18 | EDPEVKFNWYVDGVEVHNAKTKPREEQYASTYRVVSVLTVLHQDWLNGKEYKCKVSNKALPAPIEKTISKAKGQP |
| Ab19 | EDPEVKFNWYVDGVEVHNAKTKPREEQYASTYRVVSVLTVLHQDWLNGKEYKCKVSNKALPAPIEKTISKAKGQP |
| Ab20 | EDPEVKFNWYVDGVEVHNAKTKPREEQYASTYRVVSVLTVLHQDWLNGKEYKCKVSNKALPAPIEKTISKAKGQP |
| Ab21 | EDPEVKFNWYVDGVEVHNAKTKPREEQYASTYRVVSVLTVLHQDWLNGKEYKCKVSNKALPAPIEKTISKAKGQP |
| Ab22 | EDPEVKFNWYVDGVEVHNAKTKPREEQYASTYRVVSVLTVLHQDWLNGKEYKCKVSNKALPAPIEKTISKAKGQP |
| Ab23 | EDPEVKFNWYVDGVEVHNAKTKPREEQYASTYRVVSVLTVLHQDWLNGKEYKCKVSNKALPAPIEKTISKAKGQP |
| Ab24 | EDPEVKFNWYVDGVEVHNAKTKPREEQYASTYRVVSVLTVLHQDWLNGKEYKCKVSNKALPAPIEKTISKAKGQP |

Figure 1F
Antibody Heavy chain Protein features

| Sequence Name | Constant region |
|---|---|
| Ab1 | REPQVYTLPPSREEMTKNQVSLTCLVKGFYPSDIAVEWESNGQPENNYKTTPPVLDSDGSFFLYSKLTVDKSRWQ |
| Ab2 | REPQVYTLPPSREEMTKNQVSLTCLVKGFYPSDIAVEWESNGQPENNYKTTPPVLDSDGSFFLYSKLTVDKSRWQ |
| Ab3 | REPQVYTLPPSREEMTKNQVSLTCLVKGFYPSDIAVEWESNGQPENNYKTTPPVLDSDGSFFLYSKLTVDKSRWQ |
| Ab4 | REPQVYTLPPSREEMTKNQVSLTCLVKGFYPSDIAVEWESNGQPENNYKTTPPVLDSDGSFFLYSKLTVDKSRWQ |
| Ab5 | REPQVYTLPPSREEMTKNQVSLTCLVKGFYPSDIAVEWESNGQPENNYKTTPPVLDSDGSFFLYSKLTVDKSRWQ |
| Ab6 | REPQVYTLPPSREEMTKNQVSLTCLVKGFYPSDIAVEWESNGQPENNYKTTPPVLDSDGSFFLYSKLTVDKSRWQ |
| Ab7 | REPQVYTLPPSREEMTKNQVSLTCLVKGFYPSDIAVEWESNGQPENNYKTTPPVLDSDGSFFLYSKLTVDKSRWQ |
| Ab8 | REPQVYTLPPSREEMTKNQVSLTCLVKGFYPSDIAVEWESNGQPENNYKTTPPVLDSDGSFFLYSKLTVDKSRWQ |
| Ab9 | REPQVYTLPPSREEMTKNQVSLTCLVKGFYPSDIAVEWESNGQPENNYKTTPPVLDSDGSFFLYSKLTVDKSRWQ |
| Ab10 | REPQVYTLPPSREEMTKNQVSLTCLVKGFYPSDIAVEWESNGQPENNYKTTPPVLDSDGSFFLYSKLTVDKSRWQ |
| Ab11 | REPQVYTLPPSREEMTKNQVSLTCLVKGFYPSDIAVEWESNGQPENNYKTTPPVLDSDGSFFLYSKLTVDKSRWQ |
| Ab12 | REPQVYTLPPSREEMTKNQVSLTCLVKGFYPSDIAVEWESNGQPENNYKTTPPVLDSDGSFFLYSKLTVDKSRWQ |
| Ab13 | REPQVYTLPPSREEMTKNQVSLTCLVKGFYPSDIAVEWESNGQPENNYKTTPPVLDSDGSFFLYSKLTVDKSRWQ |
| Ab14 | REPQVYTLPPSREEMTKNQVSLTCLVKGFYPSDIAVEWESNGQPENNYKTTPPVLDSDGSFFLYSKLTVDKSRWQ |
| Ab15 | REPQVYTLPPSREEMTKNQVSLTCLVKGFYPSDIAVEWESNGQPENNYKTTPPVLDSDGSFFLYSKLTVDKSRWQ |
| Ab16 | REPQVYTLPPSREEMTKNQVSLTCLVKGFYPSDIAVEWESNGQPENNYKTTPPVLDSDGSFFLYSKLTVDKSRWQ |
| Ab17 | REPQVYTLPPSREEMTKNQVSLTCLVKGFYPSDIAVEWESNGQPENNYKTTPPVLDSDGSFFLYSKLTVDKSRWQ |
| Ab18 | REPQVYTLPPSREEMTKNQVSLTCLVKGFYPSDIAVEWESNGQPENNYKTTPPVLDSDGSFFLYSKLTVDKSRWQ |
| Ab19 | REPQVYTLPPSREEMTKNQVSLTCLVKGFYPSDIAVEWESNGQPENNYKTTPPVLDSDGSFFLYSKLTVDKSRWQ |
| Ab20 | REPQVYTLPPSREEMTKNQVSLTCLVKGFYPSDIAVEWESNGQPENNYKTTPPVLDSDGSFFLYSKLTVDKSRWQ |
| Ab21 | REPQVYTLPPSREEMTKNQVSLTCLVKGFYPSDIAVEWESNGQPENNYKTTPPVLDSDGSFFLYSKLTVDKSRWQ |
| Ab22 | REPQVYTLPPSREEMTKNQVSLTCLVKGFYPSDIAVEWESNGQPENNYKTTPPVLDSDGSFFLYSKLTVDKSRWQ |
| Ab23 | REPQVYTLPPSREEMTKNQVSLTCLVKGFYPSDIAVEWESNGQPENNYKTTPPVLDSDGSFFLYSKLTVDKSRWQ |
| Ab24 | REPQVYTLPPSREEMTKNQVSLTCLVKGFYPSDIAVEWESNGQPENNYKTTPPVLDSDGSFFLYSKLTVDKSRWQ |

Figure 1G
Antibody Heavy chain Protein features

| Sequence Name | Constant region |
|---|---|
| Ab1 | QGNVFSCSVMHEALHNHYTQKSLSLSPGK (SEQ ID NO:1) |
| Ab2 | QGNVFSCSVMHEALHNHYTQKSLSLSPGK (SEQ ID NO:41) |
| Ab3 | QGNVFSCSVMHEALHNHYTQKSLSLSPGK (SEQ ID NO:81) |
| Ab4 | QGNVFSCSVMHEALHNHYTQKSLSLSPGK (SEQ ID NO:121) |
| Ab5 | QGNVFSCSVMHEALHNHYTQKSLSLSPGK (SEQ ID NO:161) |
| Ab6 | QGNVFSCSVMHEALHNHYTQKSLSLSPGK (SEQ ID NO:201) |
| Ab7 | QGNVFSCSVMHEALHNHYTQKSLSLSPGK (SEQ ID NO:241) |
| Ab8 | QGNVFSCSVMHEALHNHYTQKSLSLSPGK (SEQ ID NO:281) |
| Ab9 | QGNVFSCSVMHEALHNHYTQKSLSLSPGK (SEQ ID NO:321) |
| Ab10 | QGNVFSCSVMHEALHNHYTQKSLSLSPGK (SEQ ID NO:361) |
| Ab11 | QGNVFSCSVMHEALHNHYTQKSLSLSPGK (SEQ ID NO:401) |
| Ab12 | QGNVFSCSVMHEALHNHYTQKSLSLSPGK (SEQ ID NO:441) |
| Ab13 | QGNVFSCSVMHEALHNHYTQKSLSLSPGK (SEQ ID NO:481) |
| Ab14 | QGNVFSCSVMHEALHNHYTQKSLSLSPGK (SEQ ID NO:521) |
| Ab15 | QGNVFSCSVMHEALHNHYTQKSLSLSPGK (SEQ ID NO:561) |
| Ab16 | QGNVFSCSVMHEALHNHYTQKSLSLSPGK (SEQ ID NO:601) |
| Ab17 | QGNVFSCSVMHEALHNHYTQKSLSLSPGK (SEQ ID NO:641) |
| Ab18 | QGNVFSCSVMHEALHNHYTQKSLSLSPGK (SEQ ID NO:681) |
| Ab19 | QGNVFSCSVMHEALHNHYTQKSLSLSPGK (SEQ ID NO:721) |
| Ab20 | QGNVFSCSVMHEALHNHYTQKSLSLSPGK (SEQ ID NO:761) |
| Ab21 | QGNVFSCSVMHEALHNHYTQKSLSLSPGK (SEQ ID NO:801) |
| Ab22 | QGNVFSCSVMHEALHNHYTQKSLSLSPGK (SEQ ID NO:841) |
| Ab23 | QGNVFSCSVMHEALHNHYTQKSLSLSPGK (SEQ ID NO:881) |
| Ab24 | QGNVFSCSVMHEALHNHYTQKSLSLSPGK (SEQ ID NO:921) |

Figure 2A
Antibody Light chain Protein features

| Sequence Name | FR1 | CDR1 | FR2 | CDR2 |
|---|---|---|---|---|
| Ab1 | AYDLTQTPASVEVAVGGTVTIKC | QASQSVYSNWLS | WYQQKPGQPPKLLIY | DASDLAS |
| Ab2 | AYDMTQTPASVEVAVGGTVTIKC | QASQSISSHLA | WYQQKSGQPPKLLIY | RASTLES |
| Ab3 | AVLTQTPSPVSAAVGGTVTISC | QSSQSVYHNNLLS | WYQQKPGQPPKLLIY | DASKLTS |
| Ab4 | DVVMTQTPASVEAAVGGTVTIKC | QASQSIYSNLA | WYQQKPGQPPKLLIY | GASNLAS |
| Ab5 | AVLTQTPSPVSAAVGGTVTINC | QASQSVYNNLLS | WYQQKPGQPPKLLIY | DASNLAS |
| Ab6 | ADIVMTQTPASVEVAVGGTVTIKC | QASQSISAYLA | WYQQKPGQPPKLLIY | RAYTLAS |
| Ab7 | ADIVMTQSPSSLSASVGDRVTIKC | QASQSISAYLA | WYQQKPGKVPKLLIY | RAYTLAS |
| Ab8 | ADIVMTQTPASVSEPVGGTVTIKC | QASESIRNYLS | WYQQKPGQRPKLLIY | GASTLAS |
| Ab9 | AVVLTQTPASVSAAVGGTVTIKC | QASQSISTALA | WYQQKPGQPPKLLIY | AASPLAS |
| Ab10 | ANIVMTQTPASVEAAVGGTVTIKC | QASQSISNYLA | WYQQKPGQPPKLLIY | RTSTLAS |
| Ab11 | ANIVMTQSPSSLSASVGDRVTITC | QASQSISNYLA | WYQQKPGKVPKLLIY | RTSTLAS |
| Ab12 | ANIVMTQSPSSLSASVGDRVTITC | QASQSISNYLA | WYQQKPGKVPKLLIY | RTSTLAS |
| Ab13 | AFELTQTPSPVSAAVGGTVTIKC | QASQSISTALA | WYQQKPGQPPKLLIY | GASNLES |
| Ab14 | ADIVMTQTPSPVSGAVGGTVTINC | QASQSISSYLA | WYQQKPGQPPKLLIY | RASTLAS |
| Ab15 | ANIVMTQTPSPVSGAVGGTVTIKC | QASQSISDYLA | WYQQKPGQPPKLLIY | RASTLAS |
| Ab16 | ADIVMTQTPASVEAAVGGTVTIKC | QASQSISSYLA | WYQQKPGQPPKLLIY | RASTLAS |
| Ab17 | ADVVMTQTPASVEAAVGGTVTIKC | QASLSIADYLA | WYLQKPGQPPKLLIY | RASTLAS |
| Ab18 | ADIVMTQSPSSLSASVGDRVTIKC | QASQSISAYLA | WYQQKPGKVPKLLIY | RAYTLAS |
| Ab19 | DIQMTQSPSTLSASVGDRVTITC | QASQSISTALA | WYQQKPGKAPKLLIY | AASPLAS |
| Ab20 | DIQMTQSPSTLSASVGDRVTITC | QASQSISTALA | WYQQKPGKAPKLLIY | AASPLAS |
| Ab21 | AAVLTQTPSPVSAAVGGTVSISC | QSSKSVYSNYLS | WFQQKPGQPPKFLIY | KASTLAS |
| Ab22 | AVLTQSPSTLSASVGDRVTITC | QSSKSVYSNYLS | WFQQKPGKAPKFLIY | KASTLAS |
| Ab23 | DVVMTQTPASVSEPVGGTVTIKC | QASERIYSGLA | WYQQKPGQPPKLLIY | GASTLAS |
| Ab24 | DVVMTQTPASVSEPVGGTVTIKC | QASERIYSGLA | WYQQKPGQPPKLLIY | GASTLAS |

Figure 2B
Antibody Light chain Protein features

| Sequence Name | FR3 | CDR3 | FR4 |
|---|---|---|---|
| Ab1 | GVPSRFKGSGSGSGTQFTLTISGVQCDDAATYYC | QQGQSSSDIDNT | FGGGTEVVVK |
| Ab2 | GVSSRFKGSGSGSGTEFTLTISDLECADAATYYC | QQGYGVSDVDNG | FGGGTEVVVK |
| Ab3 | GVSSRFSGSGSGSGTQFTLTISGVQCDDAATYYC | LGGYDDDADNG | FGGGTEVVVK |
| Ab4 | GVSSRFKGSRSGSGTEYTLTISDLECADAATYYC | QCTGGGDSGNT | FGGGTEVVVK |
| Ab5 | GVPDRFSGSGSGSGTQFTLTISGVQCDDAATYYC | LGGYDDDADNA | FGGGTEVVVK |
| Ab6 | GVPSRFKGSGSGSGTQFTLTISDLECADAATYYC | QSYYSVTTNTYGNT | FGGGTEVVVK |
| Ab7 | GVPSRFSGSGSGSGTDFTLTISSLQPEDVATYYC | QSYYSVTTNTYGNT | FGGGTKVEIK |
| Ab8 | GVPSRFKGSGSGSGTDFTLTISDLECADAATYYC | QSNYGISSRSYVNG | FGGGTEVVVK |
| Ab9 | GVSSRFKSSGSGSGTEFTLTISDLECADAATYYC | QSYYGSSNIA | FGGGTELEIL |
| Ab10 | GVPSRFKGSGSGSGTQFTLTISDLECADAATYYC | QSYYSVTTVAYGNT | FGGGTEVVVK |
| Ab11 | GVPSRFSGSGSGSGTDFTLTISSLQPEDVATYYC | QSYYSVTTVAYGNT | FGGGTKVEIK |
| Ab12 | GVPSRFSGSGSGSGTDFTLTISSLQPEDVATYYC | QSYYSVTTVAYGNT | FGGGTKVEIK |
| Ab13 | GVPSRFSGSGSGSGTQFTLTISDLECADAAIYYC | QSSYGSSTLA | FGGGTEVVVK |
| Ab14 | GVPSRFKGSGSGSGTQFTLTISDLECADAATYYC | QGYYSVTTNTYGNT | FGGGTEVVVK |
| Ab15 | GVPSRFRGSGSGSGTEYTLTITDLECADAATYYC | QSYYSVTTNTYGNT | FGGGTEVVVK |
| Ab16 | GVPSRFSGSGSGSGTEFTLTISDLECADAATYYC | QSYYSVTTVTYGNT | FGGGTEVVVK |
| Ab17 | GVPSRFSGSGSGSGTDFTLTISDLECADAATYYC | QSYYSVTTNTYGNT | FGGGTEVVVK |
| Ab18 | GVPSRFSGSGSGSGTDFTLTISSLQPEDVATYYC | QSYYSVTTNTYGNT | FGGGTKVEIK |
| Ab19 | GVPSRFSGSGSGSGTEFTLTISSLQPDDFATYYC | QSYYGSSNIA | FGGGTKVEIK |
| Ab20 | GVPSRFSGSGSGSGTEFTLTISSLQPDDFATYYC | QSYYGSSNIA | FGGGTKVEIK |
| Ab21 | GVPSRFKGSGSGSGTQFTLTISDVQCDDAATYYC | AGGDTNISDNA | FGGGTEVVVK |
| Ab22 | GVPSRFSGSGSGSGTEFTLTISSLQPDDFATYYC | AGGDTNIADNA | FGGGTKVEIK |
| Ab23 | GVPSRFSGSGSGSGTDFTLTISDLECDDAAIYYC | QCTYYGSSYPNV | FGGGTEVVVK |
| Ab24 | GVPSRFKGSGSGSGTDFTLTISDLECDDAAIYYC | QATYYGSSYPNV | FGGGTEVVVK |

Figure 2C
Antibody Light chain Protein features

| Sequence Name | Constant region |
|---|---|
| Ab1 | RTVAAPSVFIFPPSDEQLKSGTASVVCLLNNFYPREAKVQWKVDNALQSGNSQESVTEQDSKDSTYSLSSTLTLSK |
| Ab2 | RTVAAPSVFIFPPSDEQLKSGTASVVCLLNNFYPREAKVQWKVDNALQSGNSQESVTEQDSKDSTYSLSSTLTLSK |
| Ab3 | RTVAAPSVFIFPPSDEQLKSGTASVVCLLNNFYPREAKVQWKVDNALQSGNSQESVTEQDSKDSTYSLSSTLTLSK |
| Ab4 | RTVAAPSVFIFPPSDEQLKSGTASVVCLLNNFYPREAKVQWKVDNALQSGNSQESVTEQDSKDSTYSLSSTLTLSK |
| Ab5 | RTVAAPSVFIFPPSDEQLKSGTASVVCLLNNFYPREAKVQWKVDNALQSGNSQESVTEQDSKDSTYSLSSTLTLSK |
| Ab6 | RTVAAPSVFIFPPSDEQLKSGTASVVCLLNNFYPREAKVQWKVDNALQSGNSQESVTEQDSKDSTYSLSSTLTLSK |
| Ab7 | RTVAAPSVFIFPPSDEQLKSGTASVVCLLNNFYPREAKVQWKVDNALQSGNSQESVTEQDSKDSTYSLSSTLTLSK |
| Ab8 | RTVAAPSVFIFPPSDEQLKSGTASVVCLLNNFYPREAKVQWKVDNALQSGNSQESVTEQDSKDSTYSLSSTLTLSK |
| Ab9 | RTVAAPSVFIFPPSDEQLKSGTASVVCLLNNFYPREAKVQWKVDNALQSGNSQESVTEQDSKDSTYSLSSTLTLSK |
| Ab10 | RTVAAPSVFIFPPSDEQLKSGTASVVCLLNNFYPREAKVQWKVDNALQSGNSQESVTEQDSKDSTYSLSSTLTLSK |
| Ab11 | RTVAAPSVFIFPPSDEQLKSGTASVVCLLNNFYPREAKVQWKVDNALQSGNSQESVTEQDSKDSTYSLSSTLTLSK |
| Ab12 | RTVAAPSVFIFPPSDEQLKSGTASVVCLLNNFYPREAKVQWKVDNALQSGNSQESVTEQDSKDSTYSLSSTLTLSK |
| Ab13 | RTVAAPSVFIFPPSDEQLKSGTASVVCLLNNFYPREAKVQWKVDNALQSGNSQESVTEQDSKDSTYSLSSTLTLSK |
| Ab14 | RTVAAPSVFIFPPSDEQLKSGTASVVCLLNNFYPREAKVQWKVDNALQSGNSQESVTEQDSKDSTYSLSSTLTLSK |
| Ab15 | RTVAAPSVFIFPPSDEQLKSGTASVVCLLNNFYPREAKVQWKVDNALQSGNSQESVTEQDSKDSTYSLSSTLTLSK |
| Ab16 | RTVAAPSVFIFPPSDEQLKSGTASVVCLLNNFYPREAKVQWKVDNALQSGNSQESVTEQDSKDSTYSLSSTLTLSK |
| Ab17 | RTVAAPSVFIFPPSDEQLKSGTASVVCLLNNFYPREAKVQWKVDNALQSGNSQESVTEQDSKDSTYSLSSTLTLSK |
| Ab18 | RTVAAPSVFIFPPSDEQLKSGTASVVCLLNNFYPREAKVQWKVDNALQSGNSQESVTEQDSKDSTYSLSSTLTLSK |
| Ab19 | RTVAAPSVFIFPPSDEQLKSGTASVVCLLNNFYPREAKVQWKVDNALQSGNSQESVTEQDSKDSTYSLSSTLTLSK |
| Ab20 | RTVAAPSVFIFPPSDEQLKSGTASVVCLLNNFYPREAKVQWKVDNALQSGNSQESVTEQDSKDSTYSLSSTLTLSK |
| Ab21 | RTVAAPSVFIFPPSDEQLKSGTASVVCLLNNFYPREAKVQWKVDNALQSGNSQESVTEQDSKDSTYSLSSTLTLSK |
| Ab22 | RTVAAPSVFIFPPSDEQLKSGTASVVCLLNNFYPREAKVQWKVDNALQSGNSQESVTEQDSKDSTYSLSSTLTLSK |
| Ab23 | RTVAAPSVFIFPPSDEQLKSGTASVVCLLNNFYPREAKVQWKVDNALQSGNSQESVTEQDSKDSTYSLSSTLTLSK |
| Ab24 | RTVAAPSVFIFPPSDEQLKSGTASVVCLLNNFYPREAKVQWKVDNALQSGNSQESVTEQDSKDSTYSLSSTLTLSK |

Figure 2D
Antibody Light chain Protein features

| Sequence Name | Constant region |
|---|---|
| Ab1 | ADYEKHKVYACEVTHQGLSSPVTKSFNRGEC (SEQ ID NO:21) |
| Ab2 | ADYEKHKVYACEVTHQGLSSPVTKSFNRGEC (SEQ ID NO:61) |
| Ab3 | ADYEKHKVYACEVTHQGLSSPVTKSFNRGEC (SEQ ID NO:101) |
| Ab4 | ADYEKHKVYACEVTHQGLSSPVTKSFNRGEC (SEQ ID NO:141) |
| Ab5 | ADYEKHKVYACEVTHQGLSSPVTKSFNRGEC (SEQ ID NO:181) |
| Ab6 | ADYEKHKVYACEVTHQGLSSPVTKSFNRGEC (SEQ ID NO:221) |
| Ab7 | ADYEKHKVYACEVTHQGLSSPVTKSFNRGEC (SEQ ID NO:261) |
| Ab8 | ADYEKHKVYACEVTHQGLSSPVTKSFNRGEC (SEQ ID NO:301) |
| Ab9 | ADYEKHKVYACEVTHQGLSSPVTKSFNRGEC (SEQ ID NO:341) |
| Ab10 | ADYEKHKVYACEVTHQGLSSPVTKSFNRGEC (SEQ ID NO:381) |
| Ab11 | ADYEKHKVYACEVTHQGLSSPVTKSFNRGEC (SEQ ID NO:421) |
| Ab12 | ADYEKHKVYACEVTHQGLSSPVTKSFNRGEC (SEQ ID NO:461) |
| Ab13 | ADYEKHKVYACEVTHQGLSSPVTKSFNRGEC (SEQ ID NO:501) |
| Ab14 | ADYEKHKVYACEVTHQGLSSPVTKSFNRGEC (SEQ ID NO:541) |
| Ab15 | ADYEKHKVYACEVTHQGLSSPVTKSFNRGEC (SEQ ID NO:581) |
| Ab16 | ADYEKHKVYACEVTHQGLSSPVTKSFNRGEC (SEQ ID NO:621) |
| Ab17 | ADYEKHKVYACEVTHQGLSSPVTKSFNRGEC (SEQ ID NO:661) |
| Ab18 | ADYEKHKVYACEVTHQGLSSPVTKSFNRGEC (SEQ ID NO:701) |
| Ab19 | ADYEKHKVYACEVTHQGLSSPVTKSFNRGEC (SEQ ID NO:741) |
| Ab20 | ADYEKHKVYACEVTHQGLSSPVTKSFNRGEC (SEQ ID NO:781) |
| Ab21 | ADYEKHKVYACEVTHQGLSSPVTKSFNRGEC (SEQ ID NO:821) |
| Ab22 | ADYEKHKVYACEVTHQGLSSPVTKSFNRGEC (SEQ ID NO:861) |
| Ab23 | ADYEKHKVYACEVTHQGLSSPVTKSFNRGEC (SEQ ID NO:901) |
| Ab24 | ADYEKHKVYACEVTHQGLSSPVTKSFNRGEC (SEQ ID NO:941) |

Figure 3A
Antibody Heavy chain DNA features

|  | FR1 |
|---|---|
| Sequence Name | |
| Ab1 | cagtcggtggaggagtccggggggtcgcctggtcacgcctgttcacgcctggacacctgacactcacctgcacagtctctggat |
| Ab2 | cagtcggtggaggagtccggggggtcgcctggtcacgcctggtcacgcctggacacctgacactcacctgcacagtctctggat |
| Ab3 | cagtcggtggaggagtccggggggtcgcctggtcacgcctggtcacgcctggacacctgacactcacctgcacagtctctggat |
| Ab4 | cagtcggtggaggagtccggggggtcgcctggtcacgcctggtcacgcctggacacctgacactcacctgcacagtctctggaa |
| Ab5 | cagtcggtggaggagtccggggggtcgcctggtcacgcctggtcacgcctggacacctgacactcacctgcacagtctctggat |
| Ab6 | caggagcagctggaggagtccgggggagacctggtcaagcctggtcaagcctggtcccctgagagctccctgtgcacagcctctg |
| Ab7 | gaggtgcagcttgtggagtctgggggaggcttggtccagcctggtcccagcctggagacctcctgtgcacagcctctg |
| Ab8 | caggagcagctggaggagtccgggggagacctggtcaagcctggtaacgcctggtcccctgagacactcacctgcacagtctctgaa |
| Ab9 | cagtcggtggaggagtccggggggtcgggggagacctggtcaagcctggtcccagcctggagacctcctgtgcacagcctctg |
| Ab10 | caggagcagctggaggagtccgggggagacctggtcaagcctggtcccagcctggagacctcctgtgcacagcctctg |
| Ab11 | gaggtgcagcttgtggagtctgggggaggcttggtccagcctggtcccagcctggagacctcctgtgcacagcctctg |
| Ab12 | gaggtgcagcttgtggagtctgggggaggcttggtccagcctggtcccagcctggagacctcctgtgcacagcctctg |
| Ab13 | cagtcggtggaggagtccgggggaggcttggtccagcctggtcccagcctggagacctcctgtgcacagcctctgaa |
| Ab14 | caggagcagctggaggagtccgggggagacctggtcaagcctggtcccagcctggagacctcctgtgcacagcctctg |
| Ab15 | caggagcagctggaggagtccgggggagacctggtcaagcctggtcccagcctggagacctcctgtgcacagcctctg |
| Ab16 | caggagcagctggaggagtccgggggagacctggtcaagcctggtcccagcctggagacctcctgtgcacagcctctg |
| Ab17 | caggagcagctggaggagtccgggggagacctggtcaagcctggtcccagcctggagacctcctgtgcacagcctctg |
| Ab18 | gaggtgcagcttgtggagtctgggggaggcttggtccagcctggtcccagcctggagacctcctgtgcacagcctctg |
| Ab19 | gaggtgcagcttgtggagtctgggggaggcttggtccagcctggtcccagcctggagacctcctgtgcacagcctctg |
| Ab20 | gaggtgcagcttgtggagtctgggggaggcttggtccagcctggtcccagcctggagacctcctgtgcacagcctctg |
| Ab21 | cagtcggtggaggagtccgggggtctgggggaggcttggtccagcctggtcacgcctggggacctcctgacactcacctgcacagtctggat |
| Ab22 | gaggtcgttgaggagtccgggggagaggcttgtggagtctgggggaggaccctggtcaagcctggggcatccctgacactcacctgcaaagcctctggat |
| Ab23 | cagtcgttgaggagtccgggggagaccctggtcaagcctggggcatccctgacactcacctgcaaagcctctggat |
| Ab24 | cagtcgttgaggagtccgggggagaccctggtcaagcctggggcatccctgacactcacctgcaaagcctctggat |

Figure 3B
Antibody Heavy chain DNA features

| Sequence Name | FR1 | CDR1 | FR2 |
|---|---|---|---|
| Ab1 | tctcctcagt | agctactgatgact | tgggtccgccaggctccagggaagggctggaatacatcgga |
| Ab2 | tctcctcagt | agctatgcaatgagc | tgggtccgccaggctccagggaaggggctggaatggatcgga |
| Ab3 | tctcctcagt | agctactacatgagc | tgggtccgccaggctccagggaagggctggaatggatcgga |
| Ab4 | tcgacctcagt | agctatgcaatgatc | tgggtccgtcaggctccagaaaaagggctggaatacatcgga |
| Ab5 | tctcctcagt | agctatgcaatgagc | tgggtccgccaggctccagggaagggctggaatggatcgga |
| Ab6 | gattctccttcagt | agcaactactggatatgc | tgggtccgccaggctccagggaaggggactggattggatcgga |
| Ab7 | gattcaccgtcagt | agcaactactggatatgc | tgggtccgtcaggctccagggaagggctggagtggatcgga |
| Ab8 | gattctccttcact | agcgactattacatgtgc | tgggtccgccaggctccagggaagggctggagtggatcgga |
| Ab9 | tcgacctcagt | agctatgcaatggggc | tgggtccgccaggctccagggaagggctggaatacatcgga |
| Ab10 | gattctccttcagt | agcagttactggatatgc | tggatccgccaggctccagggaagggctggagtggatcgga |
| Ab11 | gattcaccgtcagt | agcagttactggatatgc | tgggtccgccaggctccagggaagggctggagtggatcgca |
| Ab12 | gattcaccgtcagt | agcagttactggatatgc | tgggtccgccaggctccagggaagggctggagtggatcgga |
| Ab13 | tcgacctcagt | acctatggagtgggc | tgggtccgccaggctccagggaagggctggaatacatcgga |
| Ab14 | gattctccttcagt | agcatcgcctacatgtgc | tggatccgccaggctccagggaagggactggagtggatcgga |
| Ab15 | gattctccttcagt | agcagctactggatatgc | tgggtccgccaggctccagggaagggcctggagtggatcgga |
| Ab16 | gattctccttttagt | agtgattactggatatgc | tgggtccgccaggctccagggaagggactggagtggatcgga |
| Ab17 | gattctccttcagt | agcagctactggatatgc | tgggtccgccaggctccagggaagggctggagtggatcgga |
| Ab18 | gattcaccgtcagt | agcaactactggatatgc | tgggtccgtcaggctccagggaagggctggagtggatcgga |
| Ab19 | gaatcgacctcagt | agctatgcaatgggc | tgggtccgccaggctccagggaagggctggagtacatcgga |
| Ab20 | gaatcgacctcagt | agctatgcaatgggc | tgggtccgccaggctccagggaagggctggagtacatcgga |
| Ab21 | tctccctcagt | agttatgcaatgaat | tgggtccgccaggctccagggaagggctggagtggatcggg |
| Ab22 | gattctcctcagt | agttatgcaatgaat | tgggtccgccaggctccagggaagggctggagtggatcggg |
| Ab23 | tctcctcagt | agcggctactacatgtgc | tgggtccgccaggctccagggaagggctggagtggatcgca |
| Ab24 | tctcctcagt | agcggctactacatgtgc | tgggtccgccaggctccagggaagggctggagtggatcgca |

Figure 3C
Antibody Heavy chain DNA features

| Sequence Name | CDR2 | FR3 |
|---|---|---|
| Ab1 | atcattagtagtagtggtagcacatactacgcgacctgggcgaaaggc | cgattcaccatctccaaaacct |
| Ab2 | atcattgatgctattgataacacatactacgcgagctgggcgaaaggc | cgattcaccatctccaaaacct |
| Ab3 | atctttatcctagtggtagcacatactacgcgagctgggcgaaaggc | cgattcaccatctccaaaacct |
| Ab4 | tatattggtggtattgatagcacatactacgcgagctgggcgaaaggc | cgattcaccatctccaaaacct |
| Ab5 | atcattagtaatagtggtaccacatactacgcgagctgggcgaaaggc | cgactcaccatctccatgacct |
| Ab6 | tgcattcgtgatggtggtggcacttactacgcgagctgggcgaaaggc | cgattcaccatctccatgacct |
| Ab7 | tgcattcgtgatggtggtggcacttactacgcgctaagctgggcgaaaggc | cgattcaccatctccaaaacct |
| Ab8 | tgcattcgtgatggtggcacttactacgcgctaagctgggcgaaaggc | cgattcaccatctccaaaacct |
| Ab9 | tgcattctctactggtggcccacatactacgcgagctgggcgaaaggc | cgattcaccatctccaaaacct |
| Ab10 | atcattgttagttgtgctgctggtgggaattactacgcgagctgaactctgctaaaggc | cgattcaccatctccagaacct |
| Ab11 | tgcattcgtcgtcgtgctgctggtgggaattactacgcgctaactctgctaaaggc | cgattcaccatctccagagaca |
| Ab12 | tgcattcgtcgtcgtgctgctggtgtgaattactacgcgctaactctgctaaaggc | cgattcaccatctccagagaca |
| Ab13 | atcattagtagtagtggtagtggtagcacatactacgcgagctgggcgaaaggc | cgattcaccatctccaaaacct |
| Ab14 | tgcattggttctggttctggttaatagtgggtagtaacacttactacgcgaactgggcgaaaggc | cgattcaccatctccaaaagct |
| Ab15 | tgcattgatgctgataagtgggagttactacgcacttactacgcgaactacgcgagctgggcgaaaggc | cgattcaccatctccaaggcct |
| Ab16 | tgcattcgtgatggtggtagtgcggattactactacgcgaactgggcgaaaggc | cgattcaccatctccatgacct |
| Ab17 | tgcattcgtcgtgctcctgatgtgtgtagtgcacttactacgcgagctgggcgaaaggc | cgattcaccatctccagagcct |
| Ab18 | tgcattcgtcgtgatgtggtatgggcccacatactacgcgagctgggcgaaaggc | cgattcaccatctccagaggc |
| Ab19 | atcattgttagttagttatgggcccacatactacgcgagctgggctaaaggc | cgattcaccatctccagagaca |
| Ab20 | atcattgttagttagttagtggtgccacatactacgcgctagctgggctaaaggc | cgattcaccatctccagagaca |
| Ab21 | gccattcgtagtggtggtgccacatactacgcttcgcgagctgggctgaatggc | cgtttcaccatctccaaaacct |
| Ab22 | gccattcgtagtggtggtgccacatactacgcttcgcgagctgggctgaatggc | agattcaccatctccagagaca |
| Ab23 | tgcatttatgctggtggtagtggtagcacttcttcgcgaactgggcgaaaggc | cgattcaccatctccaaaacct |
| Ab24 | tgcatttatgctggtggtagtggtagcacttcttcgcgaactgggcgaaaggc | cgattcaccatctccaaaacct |

Figure 3D
Antibody Heavy chain DNA features

| Sequence Name | FR3 |
|---|---|
| Ab1 | cgtcgaccacggtgtggatctgtgaaatcaccagtccgacaaccgaggacacggccacctatttctgtgccaga |
| Ab2 | cgaccacggtgtggatctgtgaaaatgaccagtcctgacaacgtcgaggacacggccacctatttctgtgccaga |
| Ab3 | cgaccacggtgtggatctgtgaaaatcaccagtcctgacaacgtcgaggacacggccacctatttctgtggccaga |
| Ab4 | cgaccacggtgtggatctgtgaaaatgaccagtccgacaacgtcgaggacacggccacctatttctgtggccaga |
| Ab5 | cgaccacggtgtggatctgtgaaaatgaccagtccgacaacgtcgaggacacggccacctatttctgtgccaga |
| Ab6 | cgtcgaccacggtgactctgtatctgcaactgaacagtctgacagcctgacagcctgagagtgcgcacctattttgtgcgagc |
| Ab7 | attccaagaacaccctgtatcttcaaatgaacagctgacaggcctgacagcgcgaggacacggccacctatttctgtgccaga |
| Ab8 | cgtcgaccacggtgactctgcaaaatgaccagtccgacggccgaggacacggccacctatttctgtgcgaga |
| Ab9 | cgaccacggtgtggatctgtgaaaatgaccagtccgacaacgtcgaggacacggccacctatttttgtgccaga |
| Ab10 | cgtcgaccacggtgactctgtatctgcaaaatgaacagtctgacagcctgacagcgtgagagtgcgcacctatttgtgcgagc |
| Ab11 | attccaagaacaccctgtatctgtatcttcaaaatgaacagctgacaggcctgacagcgcgaggacacggccacctatttctgtgccaga |
| Ab12 | attccaagaacaccctgtatctgtatcttcaaaatgaacagctgacaggcctgacagcgcgaggacacggccacctatttctgtgcgagc |
| Ab13 | cgtcgaccacggtgactctgtatctgcaaaatgaacagtctgacagcctgacagcctgagagtgcgcacctatttgtgccaga |
| Ab14 | cgtcgaccacggtgactctgtatctgcaaaatgaacagtctgacagcctgacagcctgagagtgcgcacctatttttgtgcgagc |
| Ab15 | cgtcgaccacggtgactctgcaaaatgaccagtcgacagcctgacagcctgagagtgcgcacctatttgtgcgagc |
| Ab16 | cgtcgaccacggtggctctgtatctgcaaaatgaacagtctgacagcctgacagcctgagagtgcgcacctatttgtgcgagc |
| Ab17 | cgtcgtccacggtgactctgtatctgcaaaatgaacagtctgacagcctgacagcgcgaggacacggccacgtatttttgtgcgagc |
| Ab18 | attccaagaacaccctgtatctgtatcttcaaaatgaacagtctgacagcctgacagcgcgaggacacggccacctatttctgtgccaga |
| Ab19 | attccaagaacaccctgtatctgtatcttcaaaatgaacagctgacaggcctgacagcctgacagcctgagagtgcgcacctattctgtgccaga |
| Ab20 | attccaagtccacggtgactctgtatctgcaaaatgaacagtctgacagcctgacagcctgagagtgcgcacctatttctgtgccaga |
| Ab21 | cgaccacggtgtggatctgtgaaaatcaccagtccgacaacgtcgaggacacggccacctatttctgtgccaga |
| Ab22 | attccaagaacaccctgtatctgtatcttcaaaatgaacagctgacaggcctgacaggccgaggacacggccacctatttctgtgcgaga |
| Ab23 | cgtcgaccacggtgactctgtatctgcaaaatgaacagtctgacagcctgacagcgcgcggacacggccacctatttctgtgcgaga |
| Ab24 | cgtcgaccacggtgactctgcaaaatgaacagtctgacagcctgacagcgcgcggacacggccacctatttctgtgcgaga |

Figure 3E
Antibody Heavy chain DNA features

| Sequence Name | CDR3 | FR4 |
|---|---|---|
| Ab1 | gactctgctttagttctggtttgaattcaacatc | tggggcccggacccctcgtcaccg |
| Ab2 | gcctctattcttggttatagtattgctacgggcttttaacatc | tggggcccaggaccctcgtcaccg |
| Ab3 | ggaggtgcttatgctactcttaacttg | tggggcccggacccctcgtcaccg |
| Ab4 | tggtccggtactagtggttataataccatc | tggggcccggacccctcgtcaccg |
| Ab5 | ggaatatattggtactggagagttttaacttg | tggggcccggacccctcgtcaccg |
| Ab6 | gatattaatgatgggtggcttggccaattcaacttg | tggggcccaggaccacctcgtcaccg |
| Ab7 | gatatcaatgatgggtggcttggccaattcaacttg | tggggcccaaggaccacctcgtcaccg |
| Ab8 | gatcgatactatagttatgctgttatggtgcttatgtttatgctagcgacttg | tggggcccaggaccacctcgtcaccg |
| Ab9 | gatctggatgctaatagtagtggcttggccaattcaacttg | tggggccaggggaccctcgtcaccg |
| Ab10 | gatattaatgatgggtggcttggccaattcaacttg | tggggcccggacccctggtcaccg |
| Ab11 | gatatcaatgatgggtggcttggccaattcaacttg | tggggccaaggaccctcgtcaccg |
| Ab12 | gatatcaatgatgggtggcttggccaattcaacttg | tggggcccaggaccctcgtcaccg |
| Ab13 | gattggtctagtaataatgggtggcttattatggtatttaatatg | tggggcccaggaccctcgtcaccg |
| Ab14 | gatactaataatgggtggcttggccaattcaacttg | tggggcccaggaccctcgtcaccg |
| Ab15 | gatcttaatgatgggtggcttggccaattcaacttg | tggggcccggcaccctcgtcaccg |
| Ab16 | gatattaatgatgggtggcttggccaattcaacttg | tggggcccaggaccctcgtcaccg |
| Ab17 | gatattaatgatgggtggcttggccaattcaacttg | tggggccaggaccctggtcaccg |
| Ab18 | gatattaatgatgggtggcttggccaattcaacttg | tggggccaaggaccctcgtcaccg |
| Ab19 | gatctggatgctcaaagtagtggttactatggagctttaacatc | tggggccaaggaccctcgtcaccg |
| Ab20 | gatctggatgctcaaagtagtggttactatggagctttaacatc | tggggcccggcaccctcgtcaccg |
| Ab21 | gatactaatgatggttggttgtatattaatcggttggatctc | tggggccaaggaccctcgtcaccg |
| Ab22 | gatactaatgatggttggttgtatattaatcggttggatctc | tggggcccggcaccctcgtcaccg |
| Ab23 | gatggtggttatgctgctgctatggttatgctttctttaacttg | tggggcccggggaccctcgtcaccg |
| Ab24 | gatggtggttatgctgctgctatggttatgctttctttaacttg | tggggcccggggaccctcgtcaccg |

Figure 3F
Antibody Heavy chain DNA features

| Sequence Name | FR4 | Constant region |
|---|---|---|
| Ab1 | tctcgagc | gcctccaccaagggcccatcggtcttccccctggcaccctcctccaagagcacctctggggcacag |
| Ab2 | tctcgagc | gcctccaccaagggcccatcggtcttccccctggcaccctcctccaagagcacctctggggcacag |
| Ab3 | tctcgagc | gcctccaccaagggcccatcggtcttccccctggcaccctcctccaagagcacctctggggcacag |
| Ab4 | tctcgagc | gcctccaccaagggcccatcggtcttccccctggcaccctcctccaagagcacctctggggcacag |
| Ab5 | tctcgagc | gcctccaccaagggcccatcggtcttccccctggcaccctcctccaagagcacctctggggcacag |
| Ab6 | tctcgagc | gcctccaccaagggcccatcggtcttccccctggcaccctcctccaagagcacctctggggcacag |
| Ab7 | tctcgagc | gcctccaccaagggcccatcggtcttccccctggcaccctcctccaagagcacctctggggcacag |
| Ab8 | tctcgagc | gcctccaccaagggcccatcggtcttccccctggcaccctcctccaagagcacctctggggcacag |
| Ab9 | tctcgagc | gcctccaccaagggcccatcggtcttccccctggcaccctcctccaagagcacctctggggcacag |
| Ab10 | tctcgagc | gcctccaccaagggcccatcggtcttccccctggcaccctcctccaagagcacctctggggcacag |
| Ab11 | tctcgagc | gcctccaccaagggcccatcggtcttccccctggcaccctcctccaagagcacctctggggcacag |
| Ab12 | tctcgagc | gcctccaccaagggcccatcggtcttccccctggcaccctcctccaagagcacctctggggcacag |
| Ab13 | tctcgagc | gcctccaccaagggcccatcggtcttccccctggcaccctcctccaagagcacctctggggcacag |
| Ab14 | tctcgagc | gcctccaccaagggcccatcggtcttccccctggcaccctcctccaagagcacctctggggcacag |
| Ab15 | tctcgagc | gcctccaccaagggcccatcggtcttccccctggcaccctcctccaagagcacctctggggcacag |
| Ab16 | tctcgagc | gcctccaccaagggcccatcggtcttccccctggcaccctcctccaagagcacctctggggcacag |
| Ab17 | tctcgagc | gcctccaccaagggcccatcggtcttccccctggcaccctcctccaagagcacctctggggcacag |
| Ab18 | tctcgagc | gcctccaccaagggcccatcggtcttccccctggcaccctcctccaagagcacctctggggcacag |
| Ab19 | tctcgagc | gcctccaccaagggcccatcggtcttccccctggcaccctcctccaagagcacctctggggcacag |
| Ab20 | tctcgagc | gcctccaccaagggcccatcggtcttccccctggcaccctcctccaagagcacctctggggcacag |
| Ab21 | tctcgagc | gcctccaccaagggcccatcggtcttccccctggcaccctcctccaagagcacctctggggcacag |
| Ab22 | tctcgagc | gcctccaccaagggcccatcggtcttccccctggcaccctcctccaagagcacctctggggcacag |
| Ab23 | tctcgagc | gcctccaccaagggcccatcggtcttccccctggcaccctcctccaagagcacctctggggcacag |
| Ab24 | tctcgagc | gcctccaccaagggcccatcggtcttccccctggcaccctcctccaagagcacctctggggcacag |

Figure 3G
Antibody Heavy chain DNA features

| Sequence Name | Constant region |
|---|---|
| Ab1 | cggccctgggctgcctggtcaaggactacttccccgaaccgttgacggtgtcgtggaactcaggcgccctgacca |
| Ab2 | cggccctgggctgcctggtcaaggactacttccccgaaccgttgacggtgtcgtggaactcaggcgccctgacca |
| Ab3 | cggccctgggctgcctggtcaaggactacttccccgaaccgttgacggtgtcgtggaactcaggcgccctgacca |
| Ab4 | cggccctgggctgcctggtcaaggactacttccccgaaccgttgacggtgtcgtggaactcaggcgccctgacca |
| Ab5 | cggccctgggctgcctggtcaaggactacttccccgaaccgttgacggtgtcgtggaactcaggcgccctgacca |
| Ab6 | cggccctgggctgcctggtcaaggactacttccccgaaccgttgacggtgtcgtggaactcaggcgccctgacca |
| Ab7 | cggccctgggctgcctggtcaaggactacttccccgaaccgttgacggtgtcgtggaactcaggcgccctgacca |
| Ab8 | cggccctgggctgcctggtcaaggactacttccccgaaccgttgacggtgtcgtggaactcaggcgccctgacca |
| Ab9 | cggccctgggctgcctggtcaaggactacttccccgaaccgttgacggtgtcgtggaactcaggcgccctgacca |
| Ab10 | cggccctgggctgcctggtcaaggactacttccccgaaccgttgacggtgtcgtggaactcaggcgccctgacca |
| Ab11 | cggccctgggctgcctggtcaaggactacttccccgaaccgttgacggtgtcgtggaactcaggcgccctgacca |
| Ab12 | cggccctgggctgcctggtcaaggactacttccccgaaccgttgacggtgtcgtggaactcaggcgccctgacca |
| Ab13 | cggccctgggctgcctggtcaaggactacttccccgaaccgttgacggtgtcgtggaactcaggcgccctgacca |
| Ab14 | cggccctgggctgcctggtcaaggactacttccccgaaccgttgacggtgtcgtggaactcaggcgccctgacca |
| Ab15 | cggccctgggctgcctggtcaaggactacttccccgaaccgttgacggtgtcgtggaactcaggcgccctgacca |
| Ab16 | cggccctgggctgcctggtcaaggactacttccccgaaccgttgacggtgtcgtggaactcaggcgccctgacca |
| Ab17 | cggccctgggctgcctggtcaaggactacttccccgaaccgttgacggtgtcgtggaactcaggcgccctgacca |
| Ab18 | cggccctgggctgcctggtcaaggactacttccccgaaccgttgacggtgtcgtggaactcaggcgccctgacca |
| Ab19 | cggccctgggctgcctggtcaaggactacttccccgaaccgttgacggtgtcgtggaactcaggcgccctgacca |
| Ab20 | cggccctgggctgcctggtcaaggactacttccccgaaccgttgacggtgtcgtggaactcaggcgccctgacca |
| Ab21 | cggccctgggctgcctggtcaaggactacttccccgaaccgttgacggtgtcgtggaactcaggcgccctgacca |
| Ab22 | cggccctgggctgcctggtcaaggactacttccccgaaccgttgacggtgtcgtggaactcaggcgccctgacca |
| Ab23 | cggccctgggctgcctggtcaaggactacttccccgaaccgttgacggtgtcgtggaactcaggcgccctgacca |
| Ab24 | cggccctgggctgcctggtcaaggactacttccccgaaccgttgacggtgtcgtggaactcaggcgccctgacca |

Figure 3H
Antibody Heavy chain DNA features

| Sequence Name | Constant region |
|---|---|
| Ab1 | gcggcgtgcacaccttcccggctgtcctacagtcctgcagactctactccctcagcagcgtggtgaccgtgccct |
| Ab2 | gcggcgtgcacaccttcccggctgtcctacagtcctgcagactctactccctcagcagcgtggtgaccgtgccct |
| Ab3 | gcggcgtgcacaccttcccggctgtcctacagtcctgcagactctactccctcagcagcgtggtgaccgtgccct |
| Ab4 | gcggcgtgcacaccttcccggctgtcctacagtcctgcagactctactccctcagcagcgtggtgaccgtgccct |
| Ab5 | gcggcgtgcacaccttcccggctgtcctacagtcctgcagactctactccctcagcagcgtggtgaccgtgccct |
| Ab6 | gcggcgtgcacaccttcccggctgtcctacagtcctgcagactctactccctcagcagcgtggtgaccgtgccct |
| Ab7 | gcggcgtgcacaccttcccggctgtcctacagtcctgcagactctactccctcagcagcgtggtgaccgtgccct |
| Ab8 | gcggcgtgcacaccttcccggctgtcctacagtcctgcagactctactccctcagcagcgtggtgaccgtgccct |
| Ab9 | gcggcgtgcacaccttcccggctgtcctacagtcctgcagactctactccctcagcagcgtggtgaccgtgccct |
| Ab10 | gcggcgtgcacaccttcccggctgtcctacagtcctgcagactctactccctcagcagcgtggtgaccgtgccct |
| Ab11 | gcggcgtgcacaccttcccggctgtcctacagtcctgcagactctactccctcagcagcgtggtgaccgtgccct |
| Ab12 | gcggcgtgcacaccttcccggctgtcctacagtcctgcagactctactccctcagcagcgtggtgaccgtgccct |
| Ab13 | gcggcgtgcacaccttcccggctgtcctacagtcctgcagactctactccctcagcagcgtggtgaccgtgccct |
| Ab14 | gcggcgtgcacaccttcccggctgtcctacagtcctgcagactctactccctcagcagcgtggtgaccgtgccct |
| Ab15 | gcggcgtgcacaccttcccggctgtcctacagtcctgcagactctactccctcagcagcgtggtgaccgtgccct |
| Ab16 | gcggcgtgcacaccttcccggctgtcctacagtcctgcagactctactccctcagcagcgtggtgaccgtgccct |
| Ab17 | gcggcgtgcacaccttcccggctgtcctacagtcctgcagactctactccctcagcagcgtggtgaccgtgccct |
| Ab18 | gcggcgtgcacaccttcccggctgtcctacagtcctgcagactctactccctcagcagcgtggtgaccgtgccct |
| Ab19 | gcggcgtgcacaccttcccggctgtcctacagtcctgcagactctactccctcagcagcgtggtgaccgtgccct |
| Ab20 | gcggcgtgcacaccttcccggctgtcctacagtcctgcagactctactccctcagcagcgtggtgaccgtgccct |
| Ab21 | gcggcgtgcacaccttcccggctgtcctacagtcctgcagactctactccctcagcagcgtggtgaccgtgccct |
| Ab22 | gcggcgtgcacaccttcccggctgtcctacagtcctgcagactctactccctcagcagcgtggtgaccgtgccct |
| Ab23 | gcggcgtgcacaccttcccggctgtcctacagtcctgcagactctactccctcagcagcgtggtgaccgtgccct |
| Ab24 | gcggcgtgcacaccttcccggctgtcctacagtcctgcagactctactccctcagcagcgtggtgaccgtgccct |

Figure 3I
Antibody Heavy chain DNA features

| Sequence Name | Constant region |
|---|---|
| Ab1 | ccagcagcttgggcacccagagacctacatctgcaacgtgaatcacaagcccagcaacaccaagtggacaagagag |
| Ab2 | ccagcagcttgggcacccagagacctacatctgcaacgtgaatcacaagcccagcaacaccaagtggacaagagag |
| Ab3 | ccagcagcttgggcacccagagacctacatctgcaacgtgaatcacaagcccagcaacaccaagtggacaagagag |
| Ab4 | ccagcagcttgggcacccagagacctacatctgcaacgtgaatcacaagcccagcaacaccaagtggacaagagag |
| Ab5 | ccagcagcttgggcacccagagacctacatctgcaacgtgaatcacaagcccagcaacaccaagtggacaagagag |
| Ab6 | ccagcagcttgggcacccagagacctacatctgcaacgtgaatcacaagcccagcaacaccaagtggacaagagag |
| Ab7 | ccagcagcttgggcacccagagacctacatctgcaacgtgaatcacaagcccagcaacaccaagtggacaagagag |
| Ab8 | ccagcagcttgggcacccagagacctacatctgcaacgtgaatcacaagcccagcaacaccaagtggacaagagag |
| Ab9 | ccagcagcttgggcacccagagacctacatctgcaacgtgaatcacaagcccagcaacaccaagtggacaagagag |
| Ab10 | ccagcagcttgggcacccagagacctacatctgcaacgtgaatcacaagcccagcaacaccaagtggacaagagag |
| Ab11 | ccagcagcttgggcacccagagacctacatctgcaacgtgaatcacaagcccagcaacaccaagtggacaagagag |
| Ab12 | ccagcagcttgggcacccagagacctacatctgcaacgtgaatcacaagcccagcaacaccaagtggacaagagag |
| Ab13 | ccagcagcttgggcacccagagacctacatctgcaacgtgaatcacaagcccagcaacaccaagtggacaagagag |
| Ab14 | ccagcagcttgggcacccagagacctacatctgcaacgtgaatcacaagcccagcaacaccaagtggacaagagag |
| Ab15 | ccagcagcttgggcacccagagacctacatctgcaacgtgaatcacaagcccagcaacaccaagtggacaagagag |
| Ab16 | ccagcagcttgggcacccagagacctacatctgcaacgtgaatcacaagcccagcaacaccaagtggacaagagag |
| Ab17 | ccagcagcttgggcacccagagacctacatctgcaacgtgaatcacaagcccagcaacaccaagtggacaagagag |
| Ab18 | ccagcagcttgggcacccagagacctacatctgcaacgtgaatcacaagcccagcaacaccaagtggacaagagag |
| Ab19 | ccagcagcttgggcacccagagacctacatctgcaacgtgaatcacaagcccagcaacaccaagtggacgcgagag |
| Ab20 | ccagcagcttgggcacccagagacctacatctgcaacgtgaatcacaagcccagcaacaccaagtggacaagagag |
| Ab21 | ccagcagcttgggcacccagagacctacatctgcaacgtgaatcacaagcccagcaacaccaagtggacaagagag |
| Ab22 | ccagcagcttgggcacccagagacctacatctgcaacgtgaatcacaagcccagcaacaccaagtggacgcgagag |
| Ab23 | ccagcagcttgggcacccagagacctacatctgcaacgtgaatcacaagcccagcaacaccaagtggacgcgagag |
| Ab24 | ccagcagcttgggcacccagagacctacatctgcaacgtgaatcacaagcccagcaacaccaagtggacaagagag |

Figure 3J
Antibody Heavy chain DNA features

| Sequence Name | Constant region |
|---|---|
| Ab1 | ttgagcccaaatcttgtgacaaaactcacacatgcccagcacctgaactcctgggggaccgtcag |
| Ab2 | ttgagcccaaatcttgtgacaaaactcacacatgcccagcacctgaactcctgggggaccgtcag |
| Ab3 | ttgagcccaaatcttgtgacaaaactcacacatgcccagcacctgaactcctgggggaccgtcag |
| Ab4 | ttgagcccaaatcttgtgacaaaactcacacatgcccagcacctgaactcctgggggaccgtcag |
| Ab5 | ttgagcccaaatcttgtgacaaaactcacacatgcccagcacctgaactcctgggggaccgtcag |
| Ab6 | ttgagcccaaatcttgtgacaaaactcacacatgcccagcacctgaactcctgggggaccgtcag |
| Ab7 | ttgagcccaaatcttgtgacaaaactcacacatgcccagcacctgaactcctgggggaccgtcag |
| Ab8 | ttgagcccaaatcttgtgacaaaactcacacatgcccagcacctgaactcctgggggaccgtcag |
| Ab9 | ttgagcccaaatcttgtgacaaaactcacacatgcccagcacctgaactcctgggggaccgtcag |
| Ab10 | ttgagcccaaatcttgtgacaaaactcacacatgcccagcacctgaactcctgggggaccgtcag |
| Ab11 | ttgagcccaaatcttgtgacaaaactcacacatgcccagcacctgaactcctgggggaccgtcag |
| Ab12 | ttgagcccaaatcttgtgacaaaactcacacatgcccagcacctgaactcctgggggaccgtcag |
| Ab13 | ttgagcccaaatcttgtgacaaaactcacacatgcccagcacctgaactcctgggggaccgtcag |
| Ab14 | ttgagcccaaatcttgtgacaaaactcacacatgcccagcacctgaactcctgggggaccgtcag |
| Ab15 | ttgagcccaaatcttgtgacaaaactcacacatgcccagcacctgaactcctgggggaccgtcag |
| Ab16 | ttgagcccaaatcttgtgacaaaactcacacatgcccagcacctgaactcctgggggaccgtcag |
| Ab17 | ttgagcccaaatcttgtgacaaaactcacacatgcccagcacctgaactcctgggggaccgtcag |
| Ab18 | ttgagcccaaatcttgtgacaaaactcacacatgcccagcacctgaactcctgggggaccgtcag |
| Ab19 | ttgagcccaaatcttgtgacaaaactcacacatgcccagcacctgaactcctgggggaccgtcag |
| Ab20 | ttgagcccaaatcttgtgacaaaactcacacatgcccagcacctgaactcctgggggaccgtcag |
| Ab21 | ttgagcccaaatcttgtgacaaaactcacacatgcccagcacctgaactcctgggggaccgtcag |
| Ab22 | ttgagcccaaatcttgtgacaaaactcacacatgcccagcacctgaactcctgggggaccgtcag |
| Ab23 | ttgagcccaaatcttgtgacaaaactcacacatgcccagcacctgaactcctgggggaccgtcag |
| Ab24 | ttgagcccaaatcttgtgacaaaactcacacatgcccagcacctgaactcctgggggaccgtcag |

Figure 3K
Antibody Heavy chain DNA features

| Sequence Name | Constant region |
|---|---|
| Ab1 | tcttcctcttcccccaaaaacccaaggacacccctgagtctcctgagtctcccggaccccctgaggtcacatgcgtggtgg |
| Ab2 | tcttcctcttcccccaaaaacccaaggacacccctgagtctcctgagtctcccggaccccctgaggtcacatgcgtggtgg |
| Ab3 | tcttcctcttcccccaaaaacccaaggacacccctcatgatctcccggaccccctgaggtcacatgcgtggtgg |
| Ab4 | tcttcctcttcccccaaaaacccaaggacacccctcatgatctcccggaccccctgaggtcacatgcgtggtgg |
| Ab5 | tcttcctcttcccccaaaaacccaaggacacccctcatgatctcccggaccccctgaggtcacatgcgtggtgg |
| Ab6 | tcttcctcttcccccaaaaacccaaggacacccctcatgatctcccggaccccctgaggtcacatgcgtggtgg |
| Ab7 | tcttcctcttcccccaaaaacccaaggacacccctcatgatctcccggaccccctgaggtcacatgcgtggtgg |
| Ab8 | tcttcctcttcccccaaaaacccaaggacacccctcatgatctcccggaccccctgaggtcacatgcgtggtgg |
| Ab9 | tcttcctcttcccccaaaaacccaaggacacccctcatgatctcccggaccccctgaggtcacatgcgtggtgg |
| Ab10 | tcttcctcttcccccaaaaacccaaggacacccctcatgatctcccggaccccctgaggtcacatgcgtggtgg |
| Ab11 | tcttcctcttcccccaaaaacccaaggacacccctcatgatctcccggaccccctgaggtcacatgcgtggtgg |
| Ab12 | tcttcctcttcccccaaaaacccaaggacacccctcatgatctcccggaccccctgaggtcacatgcgtggtgg |
| Ab13 | tcttcctcttcccccaaaaacccaaggacacccctcatgatctcccggaccccctgaggtcacatgcgtggtgg |
| Ab14 | tcttcctcttcccccaaaaacccaaggacacccctcatgatctcccggaccccctgaggtcacatgcgtggtgg |
| Ab15 | tcttcctcttcccccaaaaacccaaggacacccctcatgatctcccggaccccctgaggtcacatgcgtggtgg |
| Ab16 | tcttcctcttcccccaaaaacccaaggacacccctcatgatctcccggaccccctgaggtcacatgcgtggtgg |
| Ab17 | tcttcctcttcccccaaaaacccaaggacacccctcatgatctcccggaccccctgaggtcacatgcgtggtgg |
| Ab18 | tcttcctcttcccccaaaaacccaaggacacccctcatgatctcccggaccccctgaggtcacatgcgtggtgg |
| Ab19 | tcttcctcttcccccaaaaacccaaggacacccctcatgatctcccggaccccctgaggtcacatgcgtggtgg |
| Ab20 | tcttcctcttcccccaaaaacccaaggacacccctcatgatctcccggaccccctgaggtcacatgcgtggtgg |
| Ab21 | tcttcctcttcccccaaaaacccaaggacacccctcatgatctcccggaccccctgaggtcacatgcgtggtgg |
| Ab22 | tcttcctcttcccccaaaaacccaaggacacccctcatgatctcccggaccccctgaggtcacatgcgtggtgg |
| Ab23 | tcttcctcttcccccaaaaacccaaggacacccctcatgatctcccggaccccctgaggtcacatgcgtggtgg |
| Ab24 | tcttcctcttcccccaaaaacccaaggacacccctcatgatctcccggaccccctgaggtcacatgcgtggtgg |

Figure 3L
Antibody Heavy chain DNA features

| Sequence Name | | Constant region |
|---|---|---|
| Ab1 | acgtgagccacgaagaccctgaggtcaagttcaactggtacgtggacggcgtggaggtgcataatgccaagacaa |
| Ab2 | acgtgagccacgaagaccctgaggtcaagttcaactggtacgtggacggcgtggaggtgcataatgccaagacaa |
| Ab3 | acgtgagccacgaagaccctgaggtcaagttcaactggtacgtggacggcgtggaggtgcataatgccaagacaa |
| Ab4 | acgtgagccacgaagaccctgaggtcaagttcaactggtacgtggacggcgtggaggtgcataatgccaagacaa |
| Ab5 | acgtgagccacgaagaccctgaggtcaagttcaactggtacgtggacggcgtggaggtgcataatgccaagacaa |
| Ab6 | acgtgagccacgaagaccctgaggtcaagttcaactggtacgtggacggcgtggaggtgcataatgccaagacaa |
| Ab7 | acgtgagccacgaagaccctgaggtcaagttcaactggtacgtggacggcgtggaggtgcataatgccaagacaa |
| Ab8 | acgtgagccacgaagaccctgaggtcaagttcaactggtacgtggacggcgtggaggtgcataatgccaagacaa |
| Ab9 | acgtgagccacgaagaccctgaggtcaagttcaactggtacgtggacggcgtggaggtgcataatgccaagacaa |
| Ab10 | acgtgagccacgaagaccctgaggtcaagttcaactggtacgtggacggcgtggaggtgcataatgccaagacaa |
| Ab11 | acgtgagccacgaagaccctgaggtcaagttcaactggtacgtggacggcgtggaggtgcataatgccaagacaa |
| Ab12 | acgtgagccacgaagaccctgaggtcaagttcaactggtacgtggacggcgtggaggtgcataatgccaagacaa |
| Ab13 | acgtgagccacgaagaccctgaggtcaagttcaactggtacgtggacggcgtggaggtgcataatgccaagacaa |
| Ab14 | acgtgagccacgaagaccctgaggtcaagttcaactggtacgtggacggcgtggaggtgcataatgccaagacaa |
| Ab15 | acgtgagccacgaagaccctgaggtcaagttcaactggtacgtggacggcgtggaggtgcataatgccaagacaa |
| Ab16 | acgtgagccacgaagaccctgaggtcaagttcaactggtacgtggacggcgtggaggtgcataatgccaagacaa |
| Ab17 | acgtgagccacgaagaccctgaggtcaagttcaactggtacgtggacggcgtggaggtgcataatgccaagacaa |
| Ab18 | acgtgagccacgaagaccctgaggtcaagttcaactggtacgtggacggcgtggaggtgcataatgccaagacaa |
| Ab19 | acgtgagccacgaagaccctgaggtcaagttcaactggtacgtggacggcgtggaggtgcataatgccaagacaa |
| Ab20 | acgtgagccacgaagaccctgaggtcaagttcaactggtacgtggacggcgtggaggtgcataatgccaagacaa |
| Ab21 | acgtgagccacgaagaccctgaggtcaagttcaactggtacgtggacggcgtggaggtgcataatgccaagacaa |
| Ab22 | acgtgagccacgaagaccctgaggtcaagttcaactggtacgtggacggcgtggaggtgcataatgccaagacaa |
| Ab23 | acgtgagccacgaagaccctgaggtcaagttcaactggtacgtggacggcgtggaggtgcataatgccaagacaa |
| Ab24 | acgtgagccacgaagaccctgaggtcaagttcaactggtacgtggacggcgtggaggtgcataatgccaagacaa |

Figure 3M
Antibody Heavy chain DNA features

| Sequence Name | Constant region |
|---|---|
| Ab1 | agccgcgggaggagcagtacgccagcacgtaccgccagcacgtaccgtggtggtcagtcagcgtcctcaccgtcctgcaccaggactggctga |
| Ab2 | agccgcgggaggagcagtacgccagcacgtaccgccagcacgtaccgtggtggtcagtcagcgtcctcaccgtcctgcaccaggactggctga |
| Ab3 | agccgcgggaggagcagtacgccagcacgtaccgccagcacgtaccgtggtggtcagtcagcgtcctcaccgtcctgcaccaggactggctga |
| Ab4 | agccgcgggaggagcagtacgccagcacgtaccgccagcacgtaccgtggtggtcagtcagcgtcctcaccgtcctgcaccaggactggctga |
| Ab5 | agccgcgggaggagcagtacgccagcacgtaccgccagcacgtaccgtggtggtcagtcagcgtcctcaccgtcctgcaccaggactggctga |
| Ab6 | agccgcgggaggagcagtacgccagcacgtaccgccagcacgtaccgtggtggtcagtcagcgtcctcaccgtcctgcaccaggactggctga |
| Ab7 | agccgcgggaggagcagtacgccagcacgtaccgccagcacgtaccgtggtggtcagtcagcgtcctcaccgtcctgcaccaggactggctga |
| Ab8 | agccgcgggaggagcagtacgccagcacgtaccgccagcacgtaccgtggtggtcagtcagcgtcctcaccgtcctgcaccaggactggctga |
| Ab9 | agccgcgggaggagcagtacgccagcacgtaccgccagcacgtaccgtggtggtcagtcagcgtcctcaccgtcctgcaccaggactggctga |
| Ab10 | agccgcgggaggagcagtacgccagcacgtaccgccagcacgtaccgtggtggtcagtcagcgtcctcaccgtcctgcaccaggactggctga |
| Ab11 | agccgcgggaggagcagtacgccagcacgtaccgccagcacgtaccgtggtggtcagtcagcgtcctcaccgtcctgcaccaggactggctga |
| Ab12 | agccgcgggaggagcagtacgccagcacgtaccgccagcacgtaccgtggtggtcagtcagcgtcctcaccgtcctgcaccaggactggctga |
| Ab13 | agccgcgggaggagcagtacgccagcacgtaccgccagcacgtaccgtggtggtcagtcagcgtcctcaccgtcctgcaccaggactggctga |
| Ab14 | agccgcgggaggagcagtacgccagcacgtaccgccagcacgtaccgtggtggtcagtcagcgtcctcaccgtcctgcaccaggactggctga |
| Ab15 | agccgcgggaggagcagtacgccagcacgtaccgccagcacgtaccgtggtggtcagtcagcgtcctcaccgtcctgcaccaggactggctga |
| Ab16 | agccgcgggaggagcagtacgccagcacgtaccgccagcacgtaccgtggtggtcagtcagcgtcctcaccgtcctgcaccaggactggctga |
| Ab17 | agccgcgggaggagcagtacgccagcacgtaccgccagcacgtaccgtggtggtcagtcagcgtcctcaccgtcctgcaccaggactggctga |
| Ab18 | agccgcgggaggagcagtacgccagcacgtaccgccagcacgtaccgtggtggtcagtcagcgtcctcaccgtcctgcaccaggactggctga |
| Ab19 | agccgcgggaggagcagtacgccagcacgtaccgccagcacgtaccgtggtggtcagtcagcgtcctcaccgtcctgcaccaggactggctga |
| Ab20 | agccgcgggaggagcagtacgccagcacgtaccgccagcacgtaccgtggtggtcagtcagcgtcctcaccgtcctgcaccaggactggctga |
| Ab21 | agccgcgggaggagcagtacgccagcacgtaccgccagcacgtaccgtggtggtcagtcagcgtcctcaccgtcctgcaccaggactggctga |
| Ab22 | agccgcgggaggagcagtacgccagcacgtaccgccagcacgtaccgtggtggtcagtcagcgtcctcaccgtcctgcaccaggactggctga |
| Ab23 | agccgcgggaggagcagtacgccagcacgtaccgccagcacgtaccgtggtggtcagtcagcgtcctcaccgtcctgcaccaggactggctga |
| Ab24 | agccgcgggaggagcagtacgccagcacgtaccgccagcacgtaccgtggtggtcagtcagcgtcctcaccgtcctgcaccaggactggctga |

Figure 3N
Antibody Heavy chain DNA features

| Sequence Name | Constant region |
|---|---|
| Ab1 | atggcaaggagtacaagtgcaaggtctccaacaaagcccctcccagcccccatcgagaaaaccatctccaaagcca |
| Ab2 | atggcaaggagtacaagtgcaaggtctccaacaaagcccctcccagcccccatcgagaaaaccatctccaaagcca |
| Ab3 | atggcaaggagtacaagtgcaaggtctccaacaaagcccctcccagcccccatcgagaaaaccatctccaaagcca |
| Ab4 | atggcaaggagtacaagtgcaaggtctccaacaaagcccctcccagcccccatcgagaaaaccatctccaaagcca |
| Ab5 | atggcaaggagtacaagtgcaaggtctccaacaaagcccctcccagcccccatcgagaaaaccatctccaaagcca |
| Ab6 | atggcaaggagtacaagtgcaaggtctccaacaaagcccctcccagcccccatcgagaaaaccatctccaaagcca |
| Ab7 | atggcaaggagtacaagtgcaaggtctccaacaaagcccctcccagcccccatcgagaaaaccatctccaaagcca |
| Ab8 | atggcaaggagtacaagtgcaaggtctccaacaaagcccctcccagcccccatcgagaaaaccatctccaaagcca |
| Ab9 | atggcaaggagtacaagtgcaaggtctccaacaaagcccctcccagcccccatcgagaaaaccatctccaaagcca |
| Ab10 | atggcaaggagtacaagtgcaaggtctccaacaaagcccctcccagcccccatcgagaaaaccatctccaaagcca |
| Ab11 | atggcaaggagtacaagtgcaaggtctccaacaaagcccctcccagcccccatcgagaaaaccatctccaaagcca |
| Ab12 | atggcaaggagtacaagtgcaaggtctccaacaaagcccctcccagcccccatcgagaaaaccatctccaaagcca |
| Ab13 | atggcaaggagtacaagtgcaaggtctccaacaaagcccctcccagcccccatcgagaaaaccatctccaaagcca |
| Ab14 | atggcaaggagtacaagtgcaaggtctccaacaaagcccctcccagcccccatcgagaaaaccatctccaaagcca |
| Ab15 | atggcaaggagtacaagtgcaaggtctccaacaaagcccctcccagcccccatcgagaaaaccatctccaaagcca |
| Ab16 | atggcaaggagtacaagtgcaaggtctccaacaaagcccctcccagcccccatcgagaaaaccatctccaaagcca |
| Ab17 | atggcaaggagtacaagtgcaaggtctccaacaaagcccctcccagcccccatcgagaaaaccatctccaaagcca |
| Ab18 | atggcaaggagtacaagtgcaaggtctccaacaaagcccctcccagcccccatcgagaaaaccatctccaaagcca |
| Ab19 | atggcaaggagtacaagtgcaaggtctccaacaaagcccctcccagcccccatcgagaaaaccatctccaaagcca |
| Ab20 | atggcaaggagtacaagtgcaaggtctccaacaaagcccctcccagcccccatcgagaaaaccatctccaaagcca |
| Ab21 | atggcaaggagtacaagtgcaaggtctccaacaaagcccctcccagcccccatcgagaaaaccatctccaaagcca |
| Ab22 | atggcaaggagtacaagtgcaaggtctccaacaaagcccctcccagcccccatcgagaaaaccatctccaaagcca |
| Ab23 | atggcaaggagtacaagtgcaaggtctccaacaaagcccctcccagcccccatcgagaaaaccatctccaaagcca |
| Ab24 | atggcaaggagtacaagtgcaaggtctccaacaaagcccctcccagcccccatcgagaaaaccatctccaaagcca |

Figure 30
Antibody Heavy chain DNA features

| Sequence Name | Constant region |
|---|---|
| Ab1 | aagggcagccccgagaaccacacaggtgtacaccctgcccccatcccggaggagatgaccaagaaccaggtcagcc |
| Ab2 | aagggcagccccgagaaccacacaggtgtacaccctgcccccatcccggaggagatgaccaagaaccaggtcagcc |
| Ab3 | aagggcagccccgagaaccacacaggtgtacaccctgcccccatcccggaggagatgaccaagaaccaggtcagcc |
| Ab4 | aagggcagccccgagaaccacacaggtgtacaccctgcccccatcccggaggagatgaccaagaaccaggtcagcc |
| Ab5 | aagggcagccccgagaaccacacaggtgtacaccctgcccccatcccggaggagatgaccaagaaccaggtcagcc |
| Ab6 | aagggcagccccgagaaccacacaggtgtacaccctgcccccatcccggaggagatgaccaagaaccaggtcagcc |
| Ab7 | aagggcagccccgagaaccacacaggtgtacaccctgcccccatcccggaggagatgaccaagaaccaggtcagcc |
| Ab8 | aagggcagccccgagaaccacacaggtgtacaccctgcccccatcccggaggagatgaccaagaaccaggtcagcc |
| Ab9 | aagggcagccccgagaaccacacaggtgtacaccctgcccccatcccggaggagatgaccaagaaccaggtcagcc |
| Ab10 | aagggcagccccgagaaccacacaggtgtacaccctgcccccatcccggaggagatgaccaagaaccaggtcagcc |
| Ab11 | aagggcagccccgagaaccacacaggtgtacaccctgcccccatcccggaggagatgaccaagaaccaggtcagcc |
| Ab12 | aagggcagccccgagaaccacacaggtgtacaccctgcccccatcccggaggagatgaccaagaaccaggtcagcc |
| Ab13 | aagggcagccccgagaaccacacaggtgtacaccctgcccccatcccggaggagatgaccaagaaccaggtcagcc |
| Ab14 | aagggcagccccgagaaccacacaggtgtacaccctgcccccatcccggaggagatgaccaagaaccaggtcagcc |
| Ab15 | aagggcagccccgagaaccacacaggtgtacaccctgcccccatcccggaggagatgaccaagaaccaggtcagcc |
| Ab16 | aagggcagccccgagaaccacacaggtgtacaccctgcccccatcccggaggagatgaccaagaaccaggtcagcc |
| Ab17 | aagggcagccccgagaaccacacaggtgtacaccctgcccccatcccggaggagatgaccaagaaccaggtcagcc |
| Ab18 | aagggcagccccgagaaccacacaggtgtacaccctgcccccatcccggaggagatgaccaagaaccaggtcagcc |
| Ab19 | aagggcagccccgagaaccacacaggtgtacaccctgcccccatcccggaggagatgaccaagaaccaggtcagcc |
| Ab20 | aagggcagccccgagaaccacacaggtgtacaccctgcccccatcccggaggagatgaccaagaaccaggtcagcc |
| Ab21 | aagggcagccccgagaaccacacaggtgtacaccctgcccccatcccggaggagatgaccaagaaccaggtcagcc |
| Ab22 | aagggcagccccgagaaccacacaggtgtacaccctgcccccatcccggaggagatgaccaagaaccaggtcagcc |
| Ab23 | aagggcagccccgagaaccacacaggtgtacaccctgcccccatcccggaggagatgaccaagaaccaggtcagcc |
| Ab24 | aagggcagccccgagaaccacacaggtgtacaccctgcccccatcccggaggagatgaccaagaaccaggtcagcc |

Figure 3P
Antibody Heavy chain DNA features

| Sequence Name | Constant region |
|---|---|
| Ab1 | tgacctgcctggtcaaaggcttctatcccagcgacatcgccgtggagtgggagagcaatgggcagccggagaaca |
| Ab2 | tgacctgcctggtcaaaggcttctatcccagcgacatcgccgtggagtgggagagcaatgggcagccggagaaca |
| Ab3 | tgacctgcctggtcaaaggcttctatcccagcgacatcgccgtggagtgggagagcaatgggcagccggagaaca |
| Ab4 | tgacctgcctggtcaaaggcttctatcccagcgacatcgccgtggagtgggagagcaatgggcagccggagaaca |
| Ab5 | tgacctgcctggtcaaaggcttctatcccagcgacatcgccgtggagtgggagagcaatgggcagccggagaaca |
| Ab6 | tgacctgcctggtcaaaggcttctatcccagcgacatcgccgtggagtgggagagcaatgggcagccggagaaca |
| Ab7 | tgacctgcctggtcaaaggcttctatcccagcgacatcgccgtggagtgggagagcaatgggcagccggagaaca |
| Ab8 | tgacctgcctggtcaaaggcttctatcccagcgacatcgccgtggagtgggagagcaatgggcagccggagaaca |
| Ab9 | tgacctgcctggtcaaaggcttctatcccagcgacatcgccgtggagtgggagagcaatgggcagccggagaaca |
| Ab10 | tgacctgcctggtcaaaggcttctatcccagcgacatcgccgtggagtgggagagcaatgggcagccggagaaca |
| Ab11 | tgacctgcctggtcaaaggcttctatcccagcgacatcgccgtggagtgggagagcaatgggcagccggagaaca |
| Ab12 | tgacctgcctggtcaaaggcttctatcccagcgacatcgccgtggagtgggagagcaatgggcagccggagaaca |
| Ab13 | tgacctgcctggtcaaaggcttctatcccagcgacatcgccgtggagtgggagagcaatgggcagccggagaaca |
| Ab14 | tgacctgcctggtcaaaggcttctatcccagcgacatcgccgtggagtgggagagcaatgggcagccggagaaca |
| Ab15 | tgacctgcctggtcaaaggcttctatcccagcgacatcgccgtggagtgggagagcaatgggcagccggagaaca |
| Ab16 | tgacctgcctggtcaaaggcttctatcccagcgacatcgccgtggagtgggagagcaatgggcagccggagaaca |
| Ab17 | tgacctgcctggtcaaaggcttctatcccagcgacatcgccgtggagtgggagagcaatgggcagccggagaaca |
| Ab18 | tgacctgcctggtcaaaggcttctatcccagcgacatcgccgtggagtgggagagcaatgggcagccggagaaca |
| Ab19 | tgacctgcctggtcaaaggcttctatcccagcgacatcgccgtggagtgggagagcaatgggcagccggagaaca |
| Ab20 | tgacctgcctggtcaaaggcttctatcccagcgacatcgccgtggagtgggagagcaatgggcagccggagaaca |
| Ab21 | tgacctgcctggtcaaaggcttctatcccagcgacatcgccgtggagtgggagagcaatgggcagccggagaaca |
| Ab22 | tgacctgcctggtcaaaggcttctatcccagcgacatcgccgtggagtgggagagcaatgggcagccggagaaca |
| Ab23 | tgacctgcctggtcaaaggcttctatcccagcgacatcgccgtggagtgggagagcaatgggcagccggagaaca |
| Ab24 | tgacctgcctggtcaaaggcttctatcccagcgacatcgccgtggagtgggagagcaatgggcagccggagaaca |

Figure 3Q
Antibody Heavy chain DNA features

| Sequence Name | Constant region |
|---|---|
| Ab1 | actacaagaccacgcctcccgtgctgactccgacggctcctcttcctctacagcaagctcaccgtggacaaga |
| Ab2 | actacaagaccacgcctcccgtgctgactccgacggctcctcttcctctacagcaagctcaccgtggacaaga |
| Ab3 | actacaagaccacgcctcccgtgctgactccgacggctcctcttcctctacagcaagctcaccgtggacaaga |
| Ab4 | actacaagaccacgcctcccgtgctgactccgacggctcctcttcctctacagcaagctcaccgtggacaaga |
| Ab5 | actacaagaccacgcctcccgtgctgactccgacggctcctcttcctctacagcaagctcaccgtggacaaga |
| Ab6 | actacaagaccacgcctcccgtgctgactccgacggctcctcttcctctacagcaagctcaccgtggacaaga |
| Ab7 | actacaagaccacgcctcccgtgctgactccgacggctcctcttcctctacagcaagctcaccgtggacaaga |
| Ab8 | actacaagaccacgcctcccgtgctgactccgacggctcctcttcctctacagcaagctcaccgtggacaaga |
| Ab9 | actacaagaccacgcctcccgtgctgactccgacggctcctcttcctctacagcaagctcaccgtggacaaga |
| Ab10 | actacaagaccacgcctcccgtgctgactccgacggctcctcttcctctacagcaagctcaccgtggacaaga |
| Ab11 | actacaagaccacgcctcccgtgctgactccgacggctcctcttcctctacagcaagctcaccgtggacaaga |
| Ab12 | actacaagaccacgcctcccgtgctgactccgacggctcctcttcctctacagcaagctcaccgtggacaaga |
| Ab13 | actacaagaccacgcctcccgtgctgactccgacggctcctcttcctctacagcaagctcaccgtggacaaga |
| Ab14 | actacaagaccacgcctcccgtgctgactccgacggctcctcttcctctacagcaagctcaccgtggacaaga |
| Ab15 | actacaagaccacgcctcccgtgctgactccgacggctcctcttcctctacagcaagctcaccgtggacaaga |
| Ab16 | actacaagaccacgcctcccgtgctgactccgacggctcctcttcctctacagcaagctcaccgtggacaaga |
| Ab17 | actacaagaccacgcctcccgtgctgactccgacggctcctcttcctctacagcaagctcaccgtggacaaga |
| Ab18 | actacaagaccacgcctcccgtgctgactccgacggctcctcttcctctacagcaagctcaccgtggacaaga |
| Ab19 | actacaagaccacgcctcccgtgctgactccgacggctcctcttcctctacagcaagctcaccgtggacaaga |
| Ab20 | actacaagaccacgcctcccgtgctgactccgacggctcctcttcctctacagcaagctcaccgtggacaaga |
| Ab21 | actacaagaccacgcctcccgtgctgactccgacggctcctcttcctctacagcaagctcaccgtggacaaga |
| Ab22 | actacaagaccacgcctcccgtgctgactccgacggctcctcttcctctacagcaagctcaccgtggacaaga |
| Ab23 | actacaagaccacgcctcccgtgctgactccgacggctcctcttcctctacagcaagctcaccgtggacaaga |
| Ab24 | actacaagaccacgcctcccgtgctgactccgacggctcctcttcctctacagcaagctcaccgtggacaaga |

Figure 3R
Antibody Heavy chain DNA features

| Sequence Name | Constant region |
|---|---|
| Ab1 | gcaggtggcagcagggaacgtcttctcatgctcatgctccgtgatgcatgagctctgcacaaccactacacgcagaaga |
| Ab2 | gcaggtggcagcagggaacgtcttctcatgctcatgctccgtgatgcatgagctctgcacaaccactacacgcagaaga |
| Ab3 | gcaggtggcagcagggaacgtcttctcatgctcatgctccgtgatgcatgagctctgcacaaccactacacgcagaaga |
| Ab4 | gcaggtggcagcagggaacgtcttctcatgctcatgctccgtgatgcatgagctctgcacaaccactacacgcagaaga |
| Ab5 | gcaggtggcagcagggaacgtcttctcatgctcatgctccgtgatgcatgagctctgcacaaccactacacgcagaaga |
| Ab6 | gcaggtggcagcagggaacgtcttctcatgctcatgctccgtgatgcatgagctctgcacaaccactacacgcagaaga |
| Ab7 | gcaggtggcagcagggaacgtcttctcatgctcatgctccgtgatgcatgagctctgcacaaccactacacgcagaaga |
| Ab8 | gcaggtggcagcagggaacgtcttctcatgctcatgctccgtgatgcatgagctctgcacaaccactacacgcagaaga |
| Ab9 | gcaggtggcagcagggaacgtcttctcatgctcatgctccgtgatgcatgagctctgcacaaccactacacgcagaaga |
| Ab10 | gcaggtggcagcagggaacgtcttctcatgctcatgctccgtgatgcatgagctctgcacaaccactacacgcagaaga |
| Ab11 | gcaggtggcagcagggaacgtcttctcatgctcatgctccgtgatgcatgagctctgcacaaccactacacgcagaaga |
| Ab12 | gcaggtggcagcagggaacgtcttctcatgctcatgctccgtgatgcatgagctctgcacaaccactacacgcagaaga |
| Ab13 | gcaggtggcagcagggaacgtcttctcatgctcatgctccgtgatgcatgagctctgcacaaccactacacgcagaaga |
| Ab14 | gcaggtggcagcagggaacgtcttctcatgctcatgctccgtgatgcatgagctctgcacaaccactacacgcagaaga |
| Ab15 | gcaggtggcagcagggaacgtcttctcatgctcatgctccgtgatgcatgagctctgcacaaccactacacgcagaaga |
| Ab16 | gcaggtggcagcagggaacgtcttctcatgctcatgctccgtgatgcatgagctctgcacaaccactacacgcagaaga |
| Ab17 | gcaggtggcagcagggaacgtcttctcatgctcatgctccgtgatgcatgagctctgcacaaccactacacgcagaaga |
| Ab18 | gcaggtggcagcagggaacgtcttctcatgctcatgctccgtgatgcatgagctctgcacaaccactacacgcagaaga |
| Ab19 | gcaggtggcagcagggaacgtcttctcatgctcatgctccgtgatgcatgagctctgcacaaccactacacgcagaaga |
| Ab20 | gcaggtggcagcagggaacgtcttctcatgctcatgctccgtgatgcatgagctctgcacaaccactacacgcagaaga |
| Ab21 | gcaggtggcagcagggaacgtcttctcatgctcatgctccgtgatgcatgagctctgcacaaccactacacgcagaaga |
| Ab22 | gcaggtggcagcagggaacgtcttctcatgctcatgctccgtgatgcatgagctctgcacaaccactacacgcagaaga |
| Ab23 | gcaggtggcagcagggaacgtcttctcatgctcatgctccgtgatgcatgagctctgcacaaccactacacgcagaaga |
| Ab24 | gcaggtggcagcagggaacgtcttctcatgctcatgctccgtgatgcatgagctctgcacaaccactacacgcagaaga |

Figure 3S

Antibody Heavy chain DNA features

| Sequence Name | Constant region | |
|---|---|---|
| Ab1 | gcctctccctgtctctccgggtaaa | (SEQ ID NO:11) |
| Ab2 | gcctctccctgtctctccgggtaaa | (SEQ ID NO:51) |
| Ab3 | gcctctccctgtctctccgggtaaa | (SEQ ID NO:91) |
| Ab4 | gcctctccctgtctctccgggtaaa | (SEQ ID NO:131) |
| Ab5 | gcctctccctgtctctccgggtaaa | (SEQ ID NO:171) |
| Ab6 | gcctctccctgtctctccgggtaaa | (SEQ ID NO:211) |
| Ab7 | gcctctccctgtctctccgggtaaa | (SEQ ID NO:251) |
| Ab8 | gcctctccctgtctctccgggtaaa | (SEQ ID NO:291) |
| Ab9 | gcctctccctgtctctccgggtaaa | (SEQ ID NO:331) |
| Ab10 | gcctctccctgtctctccgggtaaa | (SEQ ID NO:371) |
| Ab11 | gcctctccctgtctctccgggtaaa | (SEQ ID NO:411) |
| Ab12 | gcctctccctgtctctccgggtaaa | (SEQ ID NO:451) |
| Ab13 | gcctctccctgtctctccgggtaaa | (SEQ ID NO:491) |
| Ab14 | gcctctccctgtctctccgggtaaa | (SEQ ID NO:531) |
| Ab15 | gcctctccctgtctctccgggtaaa | (SEQ ID NO:571) |
| Ab16 | gcctctccctgtctctccgggtaaa | (SEQ ID NO:611) |
| Ab17 | gcctctccctgtctctccgggtaaa | (SEQ ID NO:651) |
| Ab18 | gcctctccctgtctctccgggtaaa | (SEQ ID NO:691) |
| Ab19 | gcctctccctgtctctccgggtaaa | (SEQ ID NO:731) |
| Ab20 | gcctctccctgtctctccgggtaaa | (SEQ ID NO:771) |
| Ab21 | gcctctccctgtctctccgggtaaa | (SEQ ID NO:811) |
| Ab22 | gcctctccctgtctctccgggtaaa | (SEQ ID NO:851) |
| Ab23 | gcctctccctgtctctccgggtaaa | (SEQ ID NO:891) |
| Ab24 | gcctctccctgtctctccgggtaaa | (SEQ ID NO:931) |

Figure 4A
Antibody Light chain DNA features

| Sequence Name | FR1 |
|---|---|
| Ab1 | gcctatgatctgacccagactccagcctctgtggaggtagctgtgggaggcacagtcaccatcaagtgc |
| Ab2 | gcctatgatatgacccagactccagcctctgtggaggtagctgtgggaggcacagtcaccatcaagtgc |
| Ab3 | gccgtgctgacccagagacaccatcaccgtgtctgcagctgtgggaggcacagtcaccatcagttgc |
| Ab4 | gatgttgtgatgacccagactccagcacctgcctgtgtctgcagctgtgggaggcacagtcaccatcaagtgc |
| Ab5 | gccgtgctgacccagacacctgatgtgcctctccagcctgtgtctgcagctgtgggaggcacagtcaccatcaattgc |
| Ab6 | gctgacattgtgatgacccagactctccctgtctgcatctgtgggagcacagtcaccatcaagtgc |
| Ab7 | gctgacattgtgatgacccagactctccatctccagcctgtgtctgcagactgtgggaggcacagtcaccatcaagtgc |
| Ab8 | gctgacattgtgatgacccagactccagcctgtgtctgaacctgtgggtgcacagtcaccatcaattgc |
| Ab9 | gccgtcgtgctgacccagactccagcctccagcctgtgtctgcagctgtgggagcacagtcaccatcaagtgc |
| Ab10 | gccaacattgtgatgacccagactccagcctctccatctccagcctgtctgcagctgtctgtaggaggcacagagtcaccatcactgc |
| Ab11 | gccaacattgtgatgacccagactctccatctccagcctctccatctccctgtctctgcagctctgtaggagacacagagtcaccatcaagtgc |
| Ab12 | gccaacattgtgatgacccagactctccatctccagcctctccatctccctgtctctgcagctctgtaggagagacacagagtcaccatcaagtgc |
| Ab13 | gcattcgaattgacccagactccagcactccagcactccagcctctccatccccgtctctgcagctgtctgcagctgtgggaggcacagtcaccatcaattgc |
| Ab14 | gctgacattgtgatgacccagactctccatccagcctgtgtctgcagctgtctgcaggagcacagtcaccatcaagtgc |
| Ab15 | gccaacatcgtgatgacccagactccagcctctccatctccagccctgtgtctgcagctgtgggagcacagtcaccatcaagtgc |
| Ab16 | gctgacattgtgatgacccagactccagcagtctcttccatctccaccctgtctgctgcgtcctgtaggaggcacagtcaccatcaagtgc |
| Ab17 | gccgatgttgtgatgacccagactctccttctcttccaccctgtctgtctgcatctgcagctgtgggaggcacagtcaccatcaagtgc |
| Ab18 | gctgacattgtgatgacccagtctcctcttccacctccctgtctgcagctgtgggaggcacagtcaccatcaagtgc |
| Ab19 | gacatccagatgacccagtctcctcctccatctccaccctccccgtctgtctgcatctgtaggagacagagtcaccatcacttgt |
| Ab20 | gacatccagatgacccagtctcctccatctccaccctccccgtctgtctgcatctgcagctgtgggagacagagtcaccatcagttgt |
| Ab21 | gccgccgtgctgacccagagtctctgtctccagtctcttccaccccgtctcctgcagctgtctgcagctgtgggagcacagtcagcatcactttgt |
| Ab22 | gccgtgctgacccagagtctctgcagactccctccaccctgtctgcagctgtgggagcacagtcaccatcaagtgc |
| Ab23 | gatgttgtgatgacccagactccagcctctgtctgaacctgtctgtcacagctgtgggaggcacagtcaccatcaagttgc |
| Ab24 | gatgttgtgatgacccagactccagcctctgtctgaacctgtctgtcacagctgtgggaggcacagtcaccatcaagtgc |

Figure 4B

Antibody Light chain DNA features

| Sequence Name | CDR1 | FR2 |
|---|---|---|
| Ab1 | caggccagtcagagtgttttatagtaactggttatcc | tggtatcagcagaaaccaggggcagcctcccaagctcc |
| Ab2 | cagtccagtcagagtcattagtagcaccttagcc | tggtatcagcagagaaatcaggggcagcctcccaagctcc |
| Ab3 | cagtccagtcagagtgtttatcataacaacctcttatcc | tggtatcagcagaaaccaggtcagcctcccaagctct |
| Ab4 | caggccagtcagagcattatagcaatttagcc | tggtatcagcagaaaccaggggcagcctcccaagctcc |
| Ab5 | caggccagtcagagtgtttataacaacctcttatcc | tggtatcagcagaaaccaggggcagcctcccaagctcc |
| Ab6 | caggccagtcagagcagtagtgcgtacttagcc | tggtatcagcagaaaccaggggcagcctcccaagctcc |
| Ab7 | caggccagtcagagcagtgcttacttagcc | tggtatcagcaacagaaaccaggggcagcctcccaagctcc |
| Ab8 | caggccagtgaaagcattaggaactacttatcc | tggtatcagcagaaaccaggggcagcctcccaagctcc |
| Ab9 | caggccagtcagagcattagcactgcattagcc | tggtatcagcagaaaccaggggaaaagtcccaagctcc |
| Ab10 | caggccagtcagagcattagtaattacttagcc | tggtatcagcagaaaccaggggcagcgtcccaagctcc |
| Ab11 | caggccagtcagagcattagtaattacttagcc | tggtatcagcagaaaccaggggcagcctcccaagctcc |
| Ab12 | caggccagtcagagcattagcactgcattagcc | tggtatcagcagaaaccaggggcagcctcccaagctcc |
| Ab13 | caggccagtcagagcattagtgctacttagcc | tggtatcagcagaaaccaggggaaaagtcccaagctcc |
| Ab14 | caggccagtcagagcattgactacttagcc | tggtatcagcagaaaccaggggcagcctcccaagctcc |
| Ab15 | caggccagtcagagcattgactacttagcc | tggtatcagcagaaaccaggggcagcctcccaagctcc |
| Ab16 | caggccagtgagagcattgactacttagcc | tggtatcagcagaaaccaggggaaaagtcccaagctcc |
| Ab17 | caggccagtcagtctgagcattgctgacttagcc | tggtatctcagcagaaaccaggggcagcctcccaagctcc |
| Ab18 | caggccagtcagagcattagtgctacttagcc | tggtatcagcagaaaccaggggaaaagtcccaagctcc |
| Ab19 | caggccagtcagagcattagcactgcattagcc | tggtatcagcagaaaccaggggaaaagcccccaagctcc |
| Ab20 | caggccagtcagagcattagcactgcattagcc | tggtatcagcagaaaccaggggaaaagcccctaagctcc |
| Ab21 | cagtccagtcagagtgtttatagtaactacttatcc | tggtatcagcagaaaccaggggcagcctcccaagctcc |
| Ab22 | cagtccagtcagagtgtttatagtaactacttatcc | tggtttcagcagaaaccaggggcagcctcccaagttcc |
| Ab23 | caggccagtgagaggatttatagtggttttggcc | tggtatcagcagaaaccaggggaaaagcccagcctcc |
| Ab24 | caggccagtgagaggatttatagtggttttggcc | tggtatcagcagaaaccaggggcagcctcccaagctcc |

Figure 4C
Antibody Light chain DNA features

| Sequence Name | FR2 | CDR2 | FR3 |
|---|---|---|---|
| Ab1 | tgatctat | gatgcatccgatctggcatct | gggtcccatcgcggttcaaaggcagtggatctgggacacagagttca |
| Ab2 | tgatctac | agggcatccactctggaaatct | gggtctcatcaaggttcaaaggcagtggatctgggacacagagttca |
| Ab3 | tgatctac | gatgcatccaaactgacatct | gggtctcatcgcggttcagcgcagtggatctgggacacagagttca |
| Ab4 | tgatctat | gatgcatccaatctggcatct | gggtctcatcgcggttcaaaggcagtcgatctgggacacagagtaca |
| Ab5 | tgatctat | ggtgcatccaatctggcatct | gggtctcatcgcggttcagcggcagtggatctgggacacagagttca |
| Ab6 | tgatctat | gatgcatccaatctggcatct | gggtcccatcgcggttcaaaggcagtggatctgggacacagagttca |
| Ab7 | tgatctac | agggcatacactctggcatct | gggtcccatctcgtttcagtggcagtggatctgggacacagagttca |
| Ab8 | tgatctat | agggcatacactctggcatct | gggtcccatcgcggttcaaaggcagtggatctgggacacagatttca |
| Ab9 | tgatctat | ggtgcatccactctggcatct | gggtcccatcgcggttcaaaggcagtggatctgggacacagagttca |
| Ab10 | tgatctat | gctgcatcccctctggcatct | gggtctcatcgcggttcaaaggcagtccggatctgggacacagatttca |
| Ab11 | tgatctac | aggacatccactctggcatct | gggtcccatctcgtttcagtggcagtggatctgggacagattttca |
| Ab12 | tgatctat | aggacatccactctggcatct | gggtcccatcgcggttcagcggcagtggatctgggacacagatttca |
| Ab13 | tgatctat | aggacatccactctggcatct | gggtcccatctcgtttcagcggcagtggatctgggacacagagttca |
| Ab14 | tgatctac | ggtgcatccaatctggaatct | gggtcccatcgcggttcaaaggcagtggatctgggacacagagttca |
| Ab15 | tgatctat | agggcatccactctggcatct | gggtcccatcgcggttcagaggcagtggatctgggacagagtaca |
| Ab16 | tgatctac | agggcatccactctggcatct | gggtcccatcgcggttcagcggcagtggatctgggacacagagttca |
| Ab17 | tgatctac | agggcatccactctggcctct | gggtcccatcgcggttcaaaggcagtggatctgggacagagttca |
| Ab18 | tgatctat | agggcatacactctggcatct | ggagtcccatctcgtttcagtggcagtggatctgggacacagagttca |
| Ab19 | tgatctat | gctgcatcccctctggcatct | ggagtcccatcgcggttcaaaggcagtggatctgggaacagaattca |
| Ab20 | tgatctat | gctgcatcccctctggcatct | ggagtcccatcgcggttcaaaggcagtggatctgggaacagaattca |
| Ab21 | tgatctac | aaggcatccactctggcatct | gggtcccatcgcggttcagcggcagtggatctgggacacagagttca |
| Ab22 | tgatctat | aaggcatccactctggcatct | gggtcccatcgcggttcaaaggcagtggatctgggacagattttca |
| Ab23 | tgatctat | ggtgcatccactctggcatct | gggtcccatcgcggttcaaaggcagtggatctgggacacagagttca |
| Ab24 | tgatctat | ggtgcatccactctggcatct | gggtcccatcgcggttcaaaggcagtggatctgggacagatttca |

Figure 4D
Antibody Light chain DNA features

| Sequence Name | FR3 | CDR3 |
|---|---|---|
| Ab1 | ctctcaccatcagcggcgtgcagtgtgacgatgctgcctgccacttactactgt | cagcagggcagagagtagtagtgata |
| Ab2 | ctctcaccatcagcagcgaccgtggagtgtgccgatgctgcctgccacttactactgt | caacagggttatgtggttagtgatg |
| Ab3 | ctctcaccataagcggcgtgcagtgtgacgatgctgcctgccacttactactgt | ctaggcgttatgatgatgctg |
| Ab4 | ctctcaccatcagtgacctgacctgccagtgtgccgatgatgctgcctgccacctactactgt | cagtgcactggtggtggtgatagcg |
| Ab5 | ctctcaccatcagcggcgtgcagtgtgacgatgctgcctgccacttactactgt | ctaggcggttatgatgatgctg |
| Ab6 | ctctcaccatcagcagcgaccgtgcagtgtgccgatgctgcctgccacttactactgt | caaagctattattccgttactacta |
| Ab7 | ctctcaccatcagcagcgacctgcagcctgcgagtgtgcctgccacttattactgt | caaagctactattccgttactacta |
| Ab8 | ctctcaccatcagcagcgaccctgcagcctggagatgttgcaactatactactgt | caaagcaattatggtattagtagtc |
| Ab9 | ctctcaccatcagcagcgaccagcctggagtgtgccgatgctgcctgccacttactactgt | caaagctattatggtagtagcaata |
| Ab10 | ctctcaccatcagcagcgaccagcctggagtgtgccgatgctgcctgccacttactactgt | caaagctattattccgttactactg |
| Ab11 | ctctcaccatcagcagcgaccagcctggagtgtgccgatgctgcctgccacttactactgt | caaagctactattccgttactactg |
| Ab12 | ctctcaccatcagcagcgaccagcctggagtgtgccgatgctgcctgccacttactactgt | caaagctactattccgttactactg |
| Ab13 | ctctcaccatcagcagcgaccagcctggagtgtgccgatgctgcctgccatttactactgt | caaagctcttatggtagtactactacta |
| Ab14 | ctctcaccatcagcagcgaccagcctggagtgtgccgatgctgcctgccacttactactgt | caaagctattattccgttactacta |
| Ab15 | ctctcaccatcagcagcgaccagcctggagtgtgccgatgctgcctgccacttactactgt | caaagctattattccgttactacta |
| Ab16 | ctctcaccatcagcagcgaccagcctggagtgtgccgatgctgcctgccacttactactgt | caaagctattattccgttactactg |
| Ab17 | ctctcaccatcaccagcgaccagcctggagtgtgccgatgctgcctgccacttactactgt | caaagctattattccgttactacta |
| Ab18 | ctctcaccatcagcagcgaccagcctggagatgttgcaacttattactgt | caaagctactattccgttactacta |
| Ab19 | ctctcaccatcagcagcgaccagcctggagtgtgccgatgatgattgattgcaactatactactgt | caaagctattatggtagtagcaaca |
| Ab20 | ctctcaccatcagcagcgaccagcctggagtgtgccgatgatgattgcaactatactactgt | caaagctattatggtagtagcaaca |
| Ab21 | ctctcaccatcagcagcgaccagcctggagtgtgccgatgctgatgattttgcaacttactactgc | gcaggcggtgatactaatattagtg |
| Ab22 | ctctcaccatcagcagcgaccagcctggagtgtgccgatgctgatttgcaacttactactgc | gcaggcggtgatactaatattgctg |
| Ab23 | ctctcaccatcagcagcgaccagcctggagtgtgccgatgctgccatttactactgt | caatgtacttattatggttctagtt |
| Ab24 | ctctcaccatcagcagcgaccagcctggagtgtgccgatgctgccatttactactgt | caagctacttattatggttctagtt |

Figure 4E
Antibody Light chain DNA features

| Sequence Name | CDR3 | FR4 | Constant region |
|---|---|---|---|
| Ab1 | ttgataatact | ttcggcggagggaccgaggtggtggtcaaa | cgtacggtagcggcccatctgtcttca |
| Ab2 | ttgataatggt | ttcggcggagggaccgaggtggtggtcaaa | cgtacggtagcggcccatctgtcttca |
| Ab3 | ataatggt | ttcggcggagggaccgaggtggtggtcaaa | cgtacggtagcggcccatctgtcttca |
| Ab4 | gtaatact | ttcggcggagggaccgaggtggtggtcaaa | cgtacggtagcggcccatctgtcttca |
| Ab5 | ataatgct | ttcggcggagggaccgaggtggtggtcaaa | cgtacggtagcggcccatctgtcttca |
| Ab6 | atacttatggaaatact | ttcggcggagggaccgaggtggtggtcaaa | cgtacggtagcggcccatctgtcttca |
| Ab7 | atacttatggaaatact | ttcggcggagggaaccaaggtggaaatcaaa | cgtacggtggctgcaccatctgtcttca |
| Ab8 | gtagttatgttaatggt | ttcggcggagggaccgaggtggtggtcaaa | cgtacggtagcggcccatctgtcttca |
| Ab9 | ttgct | ttcggcggagggaccgagctggagatccta | cgtacggtagcggcccatctgtcttca |
| Ab10 | ttgcttatggaaatact | ttcggcggagggaccgaggtggtggtcaaa | cgtacggtagcggcccatctgtcttca |
| Ab11 | ttgcttatggaaatact | ttcggcggagggaaccaaggtggaaatcaaa | cgtacggtggctgcaccatctgtcttca |
| Ab12 | ttgcttatggaaatact | ttcggcggagggaccgaggtggaaatcaaa | cgtacggtagcggcccatctgtcttca |
| Ab13 | tggct | ttcggcggagggaccgaggtggtggtcaaa | cgtacggtagcggcccatctgtcttca |
| Ab14 | atacttatggaaatact | ttcggcggagggaccgaggtggtggtcaaa | cgtacggtagcggcccatctgtcttca |
| Ab15 | atacttatggaaatact | ttcggcggagggaaccaaggtggaaatcaaa | cgtacggtggctgcaccatctgtcttca |
| Ab16 | ttacttatggaaatact | ttcggcggagggaccgaggtggtggtcaaa | cgtacggtagcggcccatctgtcttca |
| Ab17 | atacttatggaaatact | ttcggcggagggaccgaggtggtggtcaaa | cgtacggtagcggcccatctgtcttca |
| Ab18 | atacttatggaaatact | ttcggcggagggaaccaaggtggaaatcaaa | cgtacggtggctgcaccatctgtcttca |
| Ab19 | ttgct | ttcggcggagggaccgaggtggaaatcaaa | cgtacggtggctgcaccatctgtcttca |
| Ab20 | ttgct | ttcggcggagggaccgaggtggaaatcaaa | cgtacggtagcggcccatctgtcttca |
| Ab21 | ataatgct | ttcggcggagggaaccaaggtggaaatcaaa | cgtacggtggctgcaccatctgtcttca |
| Ab22 | ataatgct | ttcggcggagggaaccaaggtgtggtcaaa | cgtacggtagcggcccatctgtcttca |
| Ab23 | atcctaatgtt | ttcggcggagggaccgaggtggtggtcaaa | cgtacggtagcggcccatctgtcttca |
| Ab24 | atcctaatgtt | ttcggcggagggaccgaggtggtggtcaaa | cgtacggtagcggcccatctgtcttca |

Figure 4F
Antibody Light chain DNA features

| Sequence Name | Constant region |
|---|---|
| Ab1 | tcttcccgccatctgatgagcagttgaaatctggaactgcctctgttgtgtgcctgctgaataacttctatccca |
| Ab2 | tcttcccgccatctgatgagcagttgaaatctggaactgcctctgttgtgtgcctgctgaataacttctatccca |
| Ab3 | tcttcccgccatctgatgagcagttgaaatctggaactgcctctgttgtgtgcctgctgaataacttctatccca |
| Ab4 | tcttcccgccatctgatgagcagttgaaatctggaactgcctctgttgtgtgcctgctgaataacttctatccca |
| Ab5 | tcttcccgccatctgatgagcagttgaaatctggaactgcctctgttgtgtgcctgctgaataacttctatccca |
| Ab6 | tcttcccgccatctgatgagcagttgaaatctggaactgcctctgttgtgtgcctgctgaataacttctatccca |
| Ab7 | tcttcccgccatctgatgagcagttgaaatctggaactgcctctgttgtgtgcctgctgaataacttctatccca |
| Ab8 | tcttcccgccatctgatgagcagttgaaatctggaactgcctctgttgtgtgcctgctgaataacttctatccca |
| Ab9 | tcttcccgccatctgatgagcagttgaaatctggaactgcctctgttgtgtgcctgctgaataacttctatccca |
| Ab10 | tcttcccgccatctgatgagcagttgaaatctggaactgcctctgttgtgtgcctgctgaataacttctatccca |
| Ab11 | tcttcccgccatctgatgagcagttgaaatctggaactgcctctgttgtgtgcctgctgaataacttctatccca |
| Ab12 | tcttcccgccatctgatgagcagttgaaatctggaactgcctctgttgtgtgcctgctgaataacttctatccca |
| Ab13 | tcttcccgccatctgatgagcagttgaaatctggaactgcctctgttgtgtgcctgctgaataacttctatccca |
| Ab14 | tcttcccgccatctgatgagcagttgaaatctggaactgcctctgttgtgtgcctgctgaataacttctatccca |
| Ab15 | tcttcccgccatctgatgagcagttgaaatctggaactgcctctgttgtgtgcctgctgaataacttctatccca |
| Ab16 | tcttcccgccatctgatgagcagttgaaatctggaactgcctctgttgtgtgcctgctgaataacttctatccca |
| Ab17 | tcttcccgccatctgatgagcagttgaaatctggaactgcctctgttgtgtgcctgctgaataacttctatccca |
| Ab18 | tcttcccgccatctgatgagcagttgaaatctggaactgcctctgttgtgtgcctgctgaataacttctatccca |
| Ab19 | tcttcccgccatctgatgagcagttgaaatctggaactgcctctgttgtgtgcctgctgaataacttctatccca |
| Ab20 | tcttcccgccatctgatgagcagttgaaatctggaactgcctctgttgtgtgcctgctgaataacttctatccca |
| Ab21 | tcttcccgccatctgatgagcagttgaaatctggaactgcctctgttgtgtgcctgctgaataacttctatccca |
| Ab22 | tcttcccgccatctgatgagcagttgaaatctggaactgcctctgttgtgtgcctgctgaataacttctatccca |
| Ab23 | tcttcccgccatctgatgagcagttgaaatctggaactgcctctgttgtgtgcctgctgaataacttctatccca |
| Ab24 | tcttcccgccatctgatgagcagttgaaatctggaactgcctctgttgtgtgcctgctgaataacttctatccca |

Figure 4G
Antibody Light chain DNA features

| Sequence Name | Constant region |
|---|---|
| Ab1 | gagaggccaaagtacagtggaaggtggataacgcccctccaatcgggtaactcccaggagagagtgtcacagagcagg |
| Ab2 | gagaggccaaagtacagtggaaggtggataacgcccctccaatcgggtaactcccaggagagagtgtcacagagcagg |
| Ab3 | gagaggccaaagtacagtggaaggtggataacgcccctccaatcgggtaactcccaggagagagtgtcacagagcagg |
| Ab4 | gagaggccaaagtacagtggaaggtggataacgcccctccaatcgggtaactcccaggagagagtgtcacagagcagg |
| Ab5 | gagaggccaaagtacagtggaaggtggataacgcccctccaatcgggtaactcccaggagagagtgtcacagagcagg |
| Ab6 | gagaggccaaagtacagtggaaggtggataacgcccctccaatcgggtaactcccaggagagagtgtcacagagcagg |
| Ab7 | gagaggccaaagtacagtggaaggtggataacgcccctccaatcgggtaactcccaggagagagtgtcacagagcagg |
| Ab8 | gagaggccaaagtacagtggaaggtggataacgcccctccaatcgggtaactcccaggagagagtgtcacagagcagg |
| Ab9 | gagaggccaaagtacagtggaaggtggataacgcccctccaatcgggtaactcccaggagagagtgtcacagagcagg |
| Ab10 | gagaggccaaagtacagtggaaggtggataacgcccctccaatcgggtaactcccaggagagagtgtcacagagcagg |
| Ab11 | gagaggccaaagtacagtggaaggtggataacgcccctccaatcgggtaactcccaggagagagtgtcacagagcagg |
| Ab12 | gagaggccaaagtacagtggaaggtggataacgcccctccaatcgggtaactcccaggagagagtgtcacagagcagg |
| Ab13 | gagaggccaaagtacagtggaaggtggataacgcccctccaatcgggtaactcccaggagagagtgtcacagagcagg |
| Ab14 | gagaggccaaagtacagtggaaggtggataacgcccctccaatcgggtaactcccaggagagagtgtcacagagcagg |
| Ab15 | gagaggccaaagtacagtggaaggtggataacgcccctccaatcgggtaactcccaggagagagtgtcacagagcagg |
| Ab16 | gagaggccaaagtacagtggaaggtggataacgcccctccaatcgggtaactcccaggagagagtgtcacagagcagg |
| Ab17 | gagaggccaaagtacagtggaaggtggataacgcccctccaatcgggtaactcccaggagagagtgtcacagagcagg |
| Ab18 | gagaggccaaagtacagtggaaggtggataacgcccctccaatcgggtaactcccaggagagagtgtcacagagcagg |
| Ab19 | gagaggccaaagtacagtggaaggtggataacgcccctccaatcgggtaactcccaggagagagtgtcacagagcagg |
| Ab20 | gagaggccaaagtacagtggaaggtggataacgcccctccaatcgggtaactcccaggagagagtgtcacagagcagg |
| Ab21 | gagaggccaaagtacagtggaaggtggataacgcccctccaatcgggtaactcccaggagagagtgtcacagagcagg |
| Ab22 | gagaggccaaagtacagtggaaggtggataacgcccctccaatcgggtaactcccaggagagagtgtcacagagcagg |
| Ab23 | gagaggccaaagtacagtggaaggtggataacgcccctccaatcgggtaactcccaggagagagtgtcacagagcagg |
| Ab24 | gagaggccaaagtacagtggaaggtggataacgcccctccaatcgggtaactcccaggagagagtgtcacagagcagg |

Figure 4H
Antibody Light chain DNA features

| Sequence Name | Constant region |
|---|---|
| Ab1 | acagcaaggacagcacctacagcctcagcagcagcacctgacgctgagcgtgacaaagcagagactacgagaaacacaaagtct |
| Ab2 | acagcaaggacagcacctacagcctcagcagcagcacctgacgctgagcgtgacaaagcagagactacgagaaacacaaagtct |
| Ab3 | acagcaaggacagcacctacagcctcagcagcagcacctgacgctgagcgtgacaaagcagagactacgagaaacacaaagtct |
| Ab4 | acagcaaggacagcacctacagcctcagcagcagcacctgacgctgagcgtgacaaagcagagactacgagaaacacaaagtct |
| Ab5 | acagcaaggacagcacctacagcctcagcagcagcacctgacgctgagcgtgacaaagcagagactacgagaaacacaaagtct |
| Ab6 | acagcaaggacagcacctacagcctcagcagcagcacctgacgctgagcgtgacaaagcagagactacgagaaacacaaagtct |
| Ab7 | acagcaaggacagcacctacagcctcagcagcagcacctgacgctgagcgtgacaaagcagagactacgagaaacacaaagtct |
| Ab8 | acagcaaggacagcacctacagcctcagcagcagcacctgacgctgagcgtgacaaagcagagactacgagaaacacaaagtct |
| Ab9 | acagcaaggacagcacctacagcctcagcagcagcacctgacgctgagcgtgacaaagcagagactacgagaaacacaaagtct |
| Ab10 | acagcaaggacagcacctacagcctcagcagcagcacctgacgctgagcgtgacaaagcagagactacgagaaacacaaagtct |
| Ab11 | acagcaaggacagcacctacagcctcagcagcagcacctgacgctgagcgtgacaaagcagagactacgagaaacacaaagtct |
| Ab12 | acagcaaggacagcacctacagcctcagcagcagcacctgacgctgagcgtgacaaagcagagactacgagaaacacaaagtct |
| Ab13 | acagcaaggacagcacctacagcctcagcagcagcacctgacgctgagcgtgacaaagcagagactacgagaaacacaaagtct |
| Ab14 | acagcaaggacagcacctacagcctcagcagcagcacctgacgctgagcgtgacaaagcagagactacgagaaacacaaagtct |
| Ab15 | acagcaaggacagcacctacagcctcagcagcagcacctgacgctgagcgtgacaaagcagagactacgagaaacacaaagtct |
| Ab16 | acagcaaggacagcacctacagcctcagcagcagcacctgacgctgagcgtgacaaagcagagactacgagaaacacaaagtct |
| Ab17 | acagcaaggacagcacctacagcctcagcagcagcacctgacgctgagcgtgacaaagcagagactacgagaaacacaaagtct |
| Ab18 | acagcaaggacagcacctacagcctcagcagcagcacctgacgctgagcgtgacaaagcagagactacgagaaacacaaagtct |
| Ab19 | acagcaaggacagcacctacagcctcagcagcagcacctgacgctgagcgtgacaaagcagagactacgagaaacacaaagtct |
| Ab20 | acagcaaggacagcacctacagcctcagcagcagcacctgacgctgagcgtgacaaagcagagactacgagaaacacaaagtct |
| Ab21 | acagcaaggacagcacctacagcctcagcagcagcacctgacgctgagcgtgacaaagcagagactacgagaaacacaaagtct |
| Ab22 | acagcaaggacagcacctacagcctcagcagcagcacctgacgctgagcgtgacaaagcagagactacgagaaacacaaagtct |
| Ab23 | acagcaaggacagcacctacagcctcagcagcagcacctgacgctgagcgtgacaaagcagagactacgagaaacacaaagtct |
| Ab24 | acagcaaggacagcacctacagcctcagcagcagcacctgacgctgagcgtgacaaagcagagactacgagaaacacaaagtct |

Figure 4I
Antibody Light chain DNA features

| Sequence Name | | Constant region |
|---|---|---|
| Ab1 | acgcctgcgaagtcacccatcagggcctgagctcgccgtcgccgcctcgagcttcaacaggggagagtgt |
| Ab2 | acgcctgcgaagtcacccatcagggcctgagctcgccgtcgccgcctcgagcttcaacaggggagagtgt |
| Ab3 | acgcctgcgaagtcacccatcagggcctgagctcgccgtcgccgcctcgagcttcaacaggggagagtgt |
| Ab4 | acgcctgcgaagtcacccatcagggcctgagctcgccgtcgccgcctcgagcttcaacaggggagagtgt |
| Ab5 | acgcctgcgaagtcacccatcagggcctgagctcgccgtcgccgcctcgagcttcaacaggggagagtgt |
| Ab6 | acgcctgcgaagtcacccatcagggcctgagctcgccgtcgccgcctcgagcttcaacaggggagagtgt |
| Ab7 | acgcctgcgaagtcacccatcagggcctgagctcgccgtcgccgcctcgagcttcaacaggggagagtgt |
| Ab8 | acgcctgcgaagtcacccatcagggcctgagctcgccgtcgccgcctcgagcttcaacaggggagagtgt |
| Ab9 | acgcctgcgaagtcacccatcagggcctgagctcgccgtcgccgcctcgagcttcaacaggggagagtgt |
| Ab10 | acgcctgcgaagtcacccatcagggcctgagctcgccgtcgccgcctcgagcttcaacaggggagagtgt |
| Ab11 | acgcctgcgaagtcacccatcagggcctgagctcgccgtcgccgcctcgagcttcaacaggggagagtgt |
| Ab12 | acgcctgcgaagtcacccatcagggcctgagctcgccgtcgccgcctcgagcttcaacaggggagagtgt |
| Ab13 | acgcctgcgaagtcacccatcagggcctgagctcgccgtcgccgcctcgagcttcaacaggggagagtgt |
| Ab14 | acgcctgcgaagtcacccatcagggcctgagctcgccgtcgccgcctcgagcttcaacaggggagagtgt |
| Ab15 | acgcctgcgaagtcacccatcagggcctgagctcgccgtcgccgcctcgagcttcaacaggggagagtgt |
| Ab16 | acgcctgcgaagtcacccatcagggcctgagctcgccgtcgccgcctcgagcttcaacaggggagagtgt |
| Ab17 | acgcctgcgaagtcacccatcagggcctgagctcgccgtcgccgcctcgagcttcaacaggggagagtgt |
| Ab18 | acgcctgcgaagtcacccatcagggcctgagctcgccgtcgccgcctcgagcttcaacaggggagagtgt |
| Ab19 | acgcctgcgaagtcacccatcagggcctgagctcgccgtcgccgcctcgagcttcaacaggggagagtgt |
| Ab20 | acgcctgcgaagtcacccatcagggcctgagctcgccgtcgccgcctcgagcttcaacaggggagagtgt |
| Ab21 | acgcctgcgaagtcacccatcagggcctgagctcgccgtcgccgcctcgagcttcaacaggggagagtgt |
| Ab22 | acgcctgcgaagtcacccatcagggcctgagctcgccgtcgccgcctcgagcttcaacaggggagagtgt |
| Ab23 | acgcctgcgaagtcacccatcagggcctgagctcgccgtcgccgcctcgagcttcaacaggggagagtgt |
| Ab24 | acgcctgcgaagtcacccatcagggcctgagctcgccgtcgccgcctcgagcttcaacaggggagagtgt |

Figure 4J
Antibody Light chain DNA features

| Sequence Name | Constant region |
|---|---|
| Ab1 | (SEQ_ID_NO:31) |
| Ab2 | (SEQ_ID_NO:71) |
| Ab3 | (SEQ_ID_NO:111) |
| Ab4 | (SEQ_ID_NO:151) |
| Ab5 | (SEQ_ID_NO:191) |
| Ab6 | (SEQ_ID_NO:231) |
| Ab7 | (SEQ_ID_NO:271) |
| Ab8 | (SEQ_ID_NO:311) |
| Ab9 | (SEQ_ID_NO:351) |
| Ab10 | (SEQ_ID_NO:391) |
| Ab11 | (SEQ_ID_NO:431) |
| Ab12 | (SEQ_ID_NO:471) |
| Ab13 | (SEQ_ID_NO:511) |
| Ab14 | (SEQ_ID_NO:551) |
| Ab15 | (SEQ_ID_NO:591) |
| Ab16 | (SEQ_ID_NO:631) |
| Ab17 | (SEQ_ID_NO:671) |
| Ab18 | (SEQ_ID_NO:711) |
| Ab19 | (SEQ_ID_NO:751) |
| Ab20 | (SEQ_ID_NO:791) |
| Ab21 | (SEQ_ID_NO:831) |
| Ab22 | (SEQ_ID_NO:871) |
| Ab23 | (SEQ_ID_NO:911) |
| Ab24 | (SEQ_ID_NO:951) |

Figure 5
Antibody Heavy chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-118 | 2 | 30-34 | 4 | 49-64 | 6 | 96-107 | 8 |
| Ab2 | 1-119 | 42 | 30-34 | 44 | 49-64 | 46 | 95-108 | 48 |
| Ab3 | 1-114 | 82 | 30-34 | 84 | 49-64 | 86 | 95-103 | 88 |
| Ab4 | 1-115 | 122 | 30-34 | 124 | 49-64 | 126 | 95-104 | 128 |
| Ab5 | 1-116 | 162 | 30-34 | 164 | 49-64 | 166 | 95-105 | 168 |
| Ab6 | 1-120 | 202 | 31-36 | 204 | 51-66 | 206 | 98-109 | 208 |
| Ab7 | 1-121 | 242 | 31-36 | 244 | 51-66 | 246 | 99-110 | 248 |
| Ab8 | 1-126 | 282 | 31-36 | 284 | 51-67 | 286 | 99-115 | 288 |
| Ab9 | 1-120 | 322 | 30-34 | 324 | 49-64 | 326 | 95-109 | 328 |
| Ab10 | 1-120 | 362 | 31-36 | 364 | 51-66 | 366 | 98-109 | 368 |
| Ab11 | 1-121 | 402 | 31-36 | 404 | 51-66 | 406 | 99-110 | 408 |
| Ab12 | 1-121 | 442 | 31-36 | 444 | 51-66 | 446 | 99-110 | 448 |
| Ab13 | 1-120 | 482 | 30-34 | 484 | 49-64 | 486 | 96-109 | 488 |
| Ab14 | 1-121 | 522 | 31-36 | 524 | 51-67 | 526 | 99-110 | 528 |
| Ab15 | 1-122 | 562 | 31-36 | 564 | 51-68 | 566 | 100-111 | 568 |
| Ab16 | 1-120 | 602 | 31-36 | 604 | 51-66 | 606 | 98-109 | 608 |
| Ab17 | 1-120 | 642 | 31-36 | 644 | 51-66 | 646 | 98-109 | 648 |
| Ab18 | 1-121 | 682 | 31-36 | 684 | 51-66 | 686 | 99-110 | 688 |
| Ab19 | 1-123 | 722 | 31-35 | 724 | 50-65 | 726 | 98-112 | 728 |
| Ab20 | 1-123 | 762 | 31-35 | 764 | 50-65 | 766 | 98-112 | 768 |
| Ab21 | 1-118 | 802 | 30-34 | 804 | 49-64 | 806 | 95-107 | 808 |
| Ab22 | 1-121 | 842 | 31-35 | 844 | 50-65 | 846 | 98-110 | 848 |
| Ab23 | 1-123 | 882 | 30-35 | 884 | 50-67 | 886 | 99-112 | 888 |
| Ab24 | 1-123 | 922 | 30-35 | 924 | 50-67 | 926 | 99-112 | 928 |

Figure 6
Antibody Heavy chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-29 | 3 | 35-48 | 5 | 65-95 | 7 | 108-118 | 9 | 119-448 | 10 |
| Ab2 | 1-29 | 43 | 35-48 | 45 | 65-94 | 47 | 109-119 | 49 | 120-449 | 50 |
| Ab3 | 1-29 | 83 | 35-48 | 85 | 65-94 | 87 | 104-114 | 89 | 115-444 | 90 |
| Ab4 | 1-29 | 123 | 35-48 | 125 | 65-94 | 127 | 105-115 | 129 | 116-445 | 130 |
| Ab5 | 1-29 | 163 | 35-48 | 165 | 65-94 | 167 | 106-116 | 169 | 117-446 | 170 |
| Ab6 | 1-30 | 203 | 37-50 | 205 | 67-97 | 207 | 110-120 | 209 | 121-450 | 210 |
| Ab7 | 1-30 | 243 | 37-50 | 245 | 67-98 | 247 | 111-121 | 249 | 122-451 | 250 |
| Ab8 | 1-30 | 283 | 37-50 | 285 | 68-98 | 287 | 116-126 | 289 | 127-456 | 290 |
| Ab9 | 1-29 | 323 | 35-48 | 325 | 65-94 | 327 | 110-120 | 329 | 121-450 | 330 |
| Ab10 | 1-30 | 363 | 37-50 | 365 | 67-97 | 367 | 110-120 | 369 | 121-450 | 370 |
| Ab11 | 1-30 | 403 | 37-50 | 405 | 67-98 | 407 | 111-121 | 409 | 122-451 | 410 |
| Ab12 | 1-30 | 443 | 37-50 | 445 | 67-98 | 447 | 111-121 | 449 | 122-451 | 450 |
| Ab13 | 1-29 | 483 | 35-48 | 485 | 65-95 | 487 | 110-120 | 489 | 121-450 | 490 |
| Ab14 | 1-30 | 523 | 37-50 | 525 | 68-98 | 527 | 111-121 | 529 | 122-451 | 530 |
| Ab15 | 1-30 | 563 | 37-50 | 565 | 69-99 | 567 | 112-122 | 569 | 123-452 | 570 |
| Ab16 | 1-30 | 603 | 37-50 | 605 | 67-97 | 607 | 110-120 | 609 | 121-450 | 610 |
| Ab17 | 1-30 | 643 | 37-50 | 645 | 67-97 | 647 | 110-120 | 649 | 121-450 | 650 |
| Ab18 | 1-30 | 683 | 37-50 | 685 | 67-98 | 687 | 111-121 | 689 | 122-451 | 690 |
| Ab19 | 1-30 | 723 | 36-49 | 725 | 66-97 | 727 | 113-123 | 729 | 124-453 | 730 |
| Ab20 | 1-30 | 763 | 36-49 | 765 | 66-97 | 767 | 113-123 | 769 | 124-453 | 770 |
| Ab21 | 1-29 | 803 | 35-48 | 805 | 65-94 | 807 | 108-118 | 809 | 119-448 | 810 |
| Ab22 | 1-30 | 843 | 36-49 | 845 | 66-97 | 847 | 111-121 | 849 | 122-451 | 850 |
| Ab23 | 1-29 | 883 | 36-49 | 885 | 68-98 | 887 | 113-123 | 889 | 124-453 | 890 |
| Ab24 | 1-29 | 923 | 36-49 | 925 | 68-98 | 927 | 113-123 | 929 | 124-453 | 930 |

Figure 7
Antibody Light chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1  | 1-111 | 22  | 24-35 | 24  | 51-57 | 26  | 90-101 | 28  |
| Ab2  | 1-110 | 62  | 24-34 | 64  | 50-56 | 66  | 89-100 | 68  |
| Ab3  | 1-110 | 102 | 23-35 | 104 | 51-57 | 106 | 90-100 | 108 |
| Ab4  | 1-109 | 142 | 24-34 | 144 | 50-56 | 146 | 89-99  | 148 |
| Ab5  | 1-109 | 182 | 23-34 | 184 | 50-56 | 186 | 89-99  | 188 |
| Ab6  | 1-113 | 222 | 25-35 | 224 | 51-57 | 226 | 90-103 | 228 |
| Ab7  | 1-113 | 262 | 25-35 | 264 | 51-57 | 266 | 90-103 | 268 |
| Ab8  | 1-113 | 302 | 25-35 | 304 | 51-57 | 306 | 90-103 | 308 |
| Ab9  | 1-108 | 342 | 24-34 | 344 | 50-56 | 346 | 89-98  | 348 |
| Ab10 | 1-113 | 382 | 25-35 | 384 | 51-57 | 386 | 90-103 | 388 |
| Ab11 | 1-113 | 422 | 25-35 | 424 | 51-57 | 426 | 90-103 | 428 |
| Ab12 | 1-113 | 462 | 25-35 | 464 | 51-57 | 466 | 90-103 | 468 |
| Ab13 | 1-108 | 502 | 24-34 | 504 | 50-56 | 506 | 89-98  | 508 |
| Ab14 | 1-113 | 542 | 25-35 | 544 | 51-57 | 546 | 90-103 | 548 |
| Ab15 | 1-113 | 582 | 25-35 | 584 | 51-57 | 586 | 90-103 | 588 |
| Ab16 | 1-113 | 622 | 25-35 | 624 | 51-57 | 626 | 90-103 | 628 |
| Ab17 | 1-113 | 662 | 25-35 | 664 | 51-57 | 666 | 90-103 | 668 |
| Ab18 | 1-113 | 702 | 25-35 | 704 | 51-57 | 706 | 90-103 | 708 |
| Ab19 | 1-108 | 742 | 24-34 | 744 | 50-56 | 746 | 89-98  | 748 |
| Ab20 | 1-108 | 782 | 24-34 | 784 | 50-56 | 786 | 89-98  | 788 |
| Ab21 | 1-110 | 822 | 24-35 | 824 | 51-57 | 826 | 90-100 | 828 |
| Ab22 | 1-109 | 862 | 23-34 | 864 | 50-56 | 866 | 89-99  | 868 |
| Ab23 | 1-110 | 902 | 24-34 | 904 | 50-56 | 906 | 89-100 | 908 |
| Ab24 | 1-110 | 942 | 24-34 | 944 | 50-56 | 946 | 89-100 | 948 |

Figure 8
Antibody Light chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-23 | 23 | 36-50 | 25 | 58-89 | 27 | 102-111 | 29 | 112-218 | 30 |
| Ab2 | 1-23 | 63 | 35-49 | 65 | 57-88 | 67 | 101-110 | 69 | 111-217 | 70 |
| Ab3 | 1-22 | 103 | 36-50 | 105 | 58-89 | 107 | 101-110 | 109 | 111-217 | 110 |
| Ab4 | 1-23 | 143 | 35-49 | 145 | 57-88 | 147 | 100-109 | 149 | 110-216 | 150 |
| Ab5 | 1-22 | 183 | 36-50 | 185 | 58-89 | 187 | 100-109 | 189 | 110-216 | 190 |
| Ab6 | 1-24 | 223 | 36-50 | 225 | 58-89 | 227 | 104-113 | 229 | 114-220 | 230 |
| Ab7 | 1-24 | 263 | 36-50 | 265 | 58-89 | 267 | 104-113 | 269 | 114-220 | 270 |
| Ab8 | 1-24 | 303 | 36-50 | 305 | 58-89 | 307 | 104-113 | 309 | 114-220 | 310 |
| Ab9 | 1-23 | 343 | 35-49 | 345 | 57-88 | 347 | 99-108 | 349 | 109-215 | 350 |
| Ab10 | 1-24 | 383 | 36-50 | 385 | 58-89 | 387 | 104-113 | 389 | 114-220 | 390 |
| Ab11 | 1-24 | 423 | 36-50 | 425 | 58-89 | 427 | 104-113 | 429 | 114-220 | 430 |
| Ab12 | 1-24 | 463 | 36-50 | 465 | 58-89 | 467 | 104-113 | 469 | 114-220 | 470 |
| Ab13 | 1-23 | 503 | 35-49 | 505 | 57-88 | 507 | 99-108 | 509 | 109-215 | 510 |
| Ab14 | 1-24 | 543 | 36-50 | 545 | 58-89 | 547 | 104-113 | 549 | 114-220 | 550 |
| Ab15 | 1-24 | 583 | 36-50 | 585 | 58-89 | 587 | 104-113 | 589 | 114-220 | 590 |
| Ab16 | 1-24 | 623 | 36-50 | 625 | 58-89 | 627 | 104-113 | 629 | 114-220 | 630 |
| Ab17 | 1-24 | 663 | 36-50 | 665 | 58-89 | 667 | 104-113 | 669 | 114-220 | 670 |
| Ab18 | 1-24 | 703 | 36-50 | 705 | 58-89 | 707 | 104-113 | 709 | 114-220 | 710 |
| Ab19 | 1-23 | 743 | 35-49 | 745 | 57-88 | 747 | 99-108 | 749 | 109-215 | 750 |
| Ab20 | 1-23 | 783 | 35-49 | 785 | 57-88 | 787 | 99-108 | 789 | 109-215 | 790 |
| Ab21 | 1-23 | 823 | 36-50 | 825 | 58-89 | 827 | 101-110 | 829 | 111-217 | 830 |
| Ab22 | 1-22 | 863 | 35-49 | 865 | 57-88 | 867 | 100-109 | 869 | 110-216 | 870 |
| Ab23 | 1-23 | 903 | 35-49 | 905 | 57-88 | 907 | 101-110 | 909 | 111-217 | 910 |
| Ab24 | 1-23 | 943 | 35-49 | 945 | 57-88 | 947 | 101-110 | 949 | 111-217 | 950 |

Figure 9
Antibody Heavy chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-354 | 12 | 88-102 | 14 | 145-192 | 16 | 286-321 | 18 |
| Ab2 | 1-357 | 52 | 88-102 | 54 | 145-192 | 56 | 283-324 | 58 |
| Ab3 | 1-342 | 92 | 88-102 | 94 | 145-192 | 96 | 283-309 | 98 |
| Ab4 | 1-345 | 132 | 88-102 | 134 | 145-192 | 136 | 283-312 | 138 |
| Ab5 | 1-348 | 172 | 88-102 | 174 | 145-192 | 176 | 283-315 | 178 |
| Ab6 | 1-360 | 212 | 91-108 | 214 | 151-198 | 216 | 292-327 | 218 |
| Ab7 | 1-363 | 252 | 91-108 | 254 | 151-198 | 256 | 295-330 | 258 |
| Ab8 | 1-378 | 292 | 91-108 | 294 | 151-201 | 296 | 295-345 | 298 |
| Ab9 | 1-360 | 332 | 88-102 | 334 | 145-192 | 336 | 283-327 | 338 |
| Ab10 | 1-360 | 372 | 91-108 | 374 | 151-198 | 376 | 292-327 | 378 |
| Ab11 | 1-363 | 412 | 91-108 | 414 | 151-198 | 416 | 295-330 | 418 |
| Ab12 | 1-363 | 452 | 91-108 | 454 | 151-198 | 456 | 295-330 | 458 |
| Ab13 | 1-360 | 492 | 88-102 | 494 | 145-192 | 496 | 286-327 | 498 |
| Ab14 | 1-363 | 532 | 91-108 | 534 | 151-201 | 536 | 295-330 | 538 |
| Ab15 | 1-366 | 572 | 91-108 | 574 | 151-204 | 576 | 298-333 | 578 |
| Ab16 | 1-360 | 612 | 91-108 | 614 | 151-198 | 616 | 292-327 | 618 |
| Ab17 | 1-360 | 652 | 91-108 | 654 | 151-198 | 656 | 292-327 | 658 |
| Ab18 | 1-363 | 692 | 91-108 | 694 | 151-198 | 696 | 295-330 | 698 |
| Ab19 | 1-369 | 732 | 91-105 | 734 | 148-195 | 736 | 292-336 | 738 |
| Ab20 | 1-369 | 772 | 91-105 | 774 | 148-195 | 776 | 292-336 | 778 |
| Ab21 | 1-354 | 812 | 88-102 | 814 | 145-192 | 816 | 283-321 | 818 |
| Ab22 | 1-363 | 852 | 91-105 | 854 | 148-195 | 856 | 292-330 | 858 |
| Ab23 | 1-369 | 892 | 88-105 | 894 | 148-201 | 896 | 295-336 | 898 |
| Ab24 | 1-369 | 932 | 88-105 | 934 | 148-201 | 936 | 295-336 | 938 |

Figure 10
Antibody Heavy chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-87 | 13 | 103-144 | 15 | 193-285 | 17 | 322-354 | 19 | 355-1344 | 20 |
| Ab2 | 1-87 | 53 | 103-144 | 55 | 193-282 | 57 | 325-357 | 59 | 358-1347 | 60 |
| Ab3 | 1-87 | 93 | 103-144 | 95 | 193-282 | 97 | 310-342 | 99 | 343-1332 | 100 |
| Ab4 | 1-87 | 133 | 103-144 | 135 | 193-282 | 137 | 313-345 | 139 | 346-1335 | 140 |
| Ab5 | 1-87 | 173 | 103-144 | 175 | 193-282 | 177 | 316-348 | 179 | 349-1338 | 180 |
| Ab6 | 1-90 | 213 | 109-150 | 215 | 199-291 | 217 | 328-360 | 219 | 361-1350 | 220 |
| Ab7 | 1-90 | 253 | 109-150 | 255 | 199-294 | 257 | 331-363 | 259 | 364-1353 | 260 |
| Ab8 | 1-90 | 293 | 109-150 | 295 | 202-294 | 297 | 346-378 | 299 | 379-1368 | 300 |
| Ab9 | 1-87 | 333 | 103-144 | 335 | 193-282 | 337 | 328-360 | 339 | 361-1350 | 340 |
| Ab10 | 1-90 | 373 | 109-150 | 375 | 199-291 | 377 | 328-360 | 379 | 361-1350 | 380 |
| Ab11 | 1-90 | 413 | 109-150 | 415 | 199-294 | 417 | 331-363 | 419 | 364-1353 | 420 |
| Ab12 | 1-90 | 453 | 109-150 | 455 | 199-294 | 457 | 331-363 | 459 | 364-1353 | 460 |
| Ab13 | 1-87 | 493 | 103-144 | 495 | 193-285 | 497 | 328-360 | 499 | 361-1350 | 500 |
| Ab14 | 1-90 | 533 | 109-150 | 535 | 202-294 | 537 | 331-363 | 539 | 364-1353 | 540 |
| Ab15 | 1-90 | 573 | 109-150 | 575 | 205-297 | 577 | 334-366 | 579 | 367-1356 | 580 |
| Ab16 | 1-90 | 613 | 109-150 | 615 | 199-291 | 617 | 328-360 | 619 | 361-1350 | 620 |
| Ab17 | 1-90 | 653 | 109-150 | 655 | 199-291 | 657 | 328-360 | 659 | 361-1350 | 660 |
| Ab18 | 1-90 | 693 | 109-150 | 695 | 199-294 | 697 | 331-363 | 699 | 364-1353 | 700 |
| Ab19 | 1-90 | 733 | 106-147 | 735 | 196-291 | 737 | 337-369 | 739 | 370-1359 | 740 |
| Ab20 | 1-90 | 773 | 106-147 | 775 | 196-291 | 777 | 337-369 | 779 | 370-1359 | 780 |
| Ab21 | 1-87 | 813 | 103-144 | 815 | 193-282 | 817 | 322-354 | 819 | 355-1344 | 820 |
| Ab22 | 1-90 | 853 | 106-147 | 855 | 196-291 | 857 | 331-363 | 859 | 364-1353 | 860 |
| Ab23 | 1-87 | 893 | 106-147 | 895 | 202-294 | 897 | 337-369 | 899 | 370-1359 | 900 |
| Ab24 | 1-87 | 933 | 106-147 | 935 | 202-294 | 937 | 337-369 | 939 | 370-1359 | 940 |

Figure 11
Antibody Light chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-333 | 32 | 70-105 | 34 | 151-171 | 36 | 268-303 | 38 |
| Ab2 | 1-330 | 72 | 70-102 | 74 | 148-168 | 76 | 265-300 | 78 |
| Ab3 | 1-330 | 112 | 67-105 | 114 | 151-171 | 116 | 268-300 | 118 |
| Ab4 | 1-327 | 152 | 70-102 | 154 | 148-168 | 156 | 265-297 | 158 |
| Ab5 | 1-327 | 192 | 67-102 | 194 | 148-168 | 196 | 265-297 | 198 |
| Ab6 | 1-339 | 232 | 73-105 | 234 | 151-171 | 236 | 268-309 | 238 |
| Ab7 | 1-339 | 272 | 73-105 | 274 | 151-171 | 276 | 268-309 | 278 |
| Ab8 | 1-339 | 312 | 73-105 | 314 | 151-171 | 316 | 268-309 | 318 |
| Ab9 | 1-324 | 352 | 70-102 | 354 | 148-168 | 356 | 265-294 | 358 |
| Ab10 | 1-339 | 392 | 73-105 | 394 | 151-171 | 396 | 268-309 | 398 |
| Ab11 | 1-339 | 432 | 73-105 | 434 | 151-171 | 436 | 268-309 | 438 |
| Ab12 | 1-339 | 472 | 73-105 | 474 | 151-171 | 476 | 268-309 | 478 |
| Ab13 | 1-324 | 512 | 70-102 | 514 | 148-168 | 516 | 265-294 | 518 |
| Ab14 | 1-339 | 552 | 73-105 | 554 | 151-171 | 556 | 268-309 | 558 |
| Ab15 | 1-339 | 592 | 73-105 | 594 | 151-171 | 596 | 268-309 | 598 |
| Ab16 | 1-339 | 632 | 73-105 | 634 | 151-171 | 636 | 268-309 | 638 |
| Ab17 | 1-339 | 672 | 73-105 | 674 | 151-171 | 676 | 268-309 | 678 |
| Ab18 | 1-339 | 712 | 73-105 | 714 | 151-171 | 716 | 268-309 | 718 |
| Ab19 | 1-324 | 752 | 70-102 | 754 | 148-168 | 756 | 265-294 | 758 |
| Ab20 | 1-324 | 792 | 70-102 | 794 | 148-168 | 796 | 265-294 | 798 |
| Ab21 | 1-330 | 832 | 70-105 | 834 | 151-171 | 836 | 268-300 | 838 |
| Ab22 | 1-327 | 872 | 67-102 | 874 | 148-168 | 876 | 265-297 | 878 |
| Ab23 | 1-330 | 912 | 70-102 | 914 | 148-168 | 916 | 265-300 | 918 |
| Ab24 | 1-330 | 952 | 70-102 | 954 | 148-168 | 956 | 265-300 | 958 |

Figure 12
Antibody light chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-69 | 33 | 106-150 | 35 | 172-267 | 37 | 304-333 | 39 | 334-654 | 40 |
| Ab2 | 1-69 | 73 | 103-147 | 75 | 169-264 | 77 | 301-330 | 79 | 331-651 | 80 |
| Ab3 | 1-66 | 113 | 106-150 | 115 | 172-267 | 117 | 301-330 | 119 | 331-651 | 120 |
| Ab4 | 1-69 | 153 | 103-147 | 155 | 169-264 | 157 | 298-327 | 159 | 328-648 | 160 |
| Ab5 | 1-66 | 193 | 103-147 | 195 | 169-264 | 197 | 298-327 | 199 | 328-648 | 200 |
| Ab6 | 1-72 | 233 | 106-150 | 235 | 172-267 | 237 | 310-339 | 239 | 340-660 | 240 |
| Ab7 | 1-72 | 273 | 106-150 | 275 | 172-267 | 277 | 310-339 | 279 | 340-660 | 280 |
| Ab8 | 1-72 | 313 | 106-150 | 315 | 172-267 | 317 | 310-339 | 319 | 340-660 | 320 |
| Ab9 | 1-69 | 353 | 103-147 | 355 | 169-264 | 357 | 295-324 | 359 | 325-645 | 360 |
| Ab10 | 1-72 | 393 | 106-150 | 395 | 172-267 | 397 | 310-339 | 399 | 340-660 | 400 |
| Ab11 | 1-72 | 433 | 106-150 | 435 | 172-267 | 437 | 310-339 | 439 | 340-660 | 440 |
| Ab12 | 1-72 | 473 | 106-150 | 475 | 172-267 | 477 | 310-339 | 479 | 340-660 | 480 |
| Ab13 | 1-69 | 513 | 103-147 | 515 | 169-264 | 517 | 295-324 | 519 | 325-645 | 520 |
| Ab14 | 1-72 | 553 | 106-150 | 555 | 172-267 | 557 | 310-339 | 559 | 340-660 | 560 |
| Ab15 | 1-72 | 593 | 106-150 | 595 | 172-267 | 597 | 310-339 | 599 | 340-660 | 600 |
| Ab16 | 1-72 | 633 | 106-150 | 635 | 172-267 | 637 | 310-339 | 639 | 340-660 | 640 |
| Ab17 | 1-72 | 673 | 106-150 | 675 | 172-267 | 677 | 310-339 | 679 | 340-660 | 680 |
| Ab18 | 1-72 | 713 | 106-150 | 715 | 172-267 | 717 | 310-339 | 719 | 340-660 | 720 |
| Ab19 | 1-69 | 753 | 103-147 | 755 | 169-264 | 757 | 295-324 | 759 | 325-645 | 760 |
| Ab20 | 1-69 | 793 | 103-147 | 795 | 169-264 | 797 | 295-324 | 799 | 325-645 | 800 |
| Ab21 | 1-69 | 833 | 106-150 | 835 | 172-267 | 837 | 301-330 | 839 | 331-651 | 840 |
| Ab22 | 1-66 | 873 | 103-147 | 875 | 169-264 | 877 | 298-327 | 879 | 328-648 | 880 |
| Ab23 | 1-69 | 913 | 103-147 | 915 | 169-264 | 917 | 301-330 | 919 | 331-651 | 920 |
| Ab24 | 1-69 | 953 | 103-147 | 955 | 169-264 | 957 | 301-330 | 959 | 331-651 | 960 |

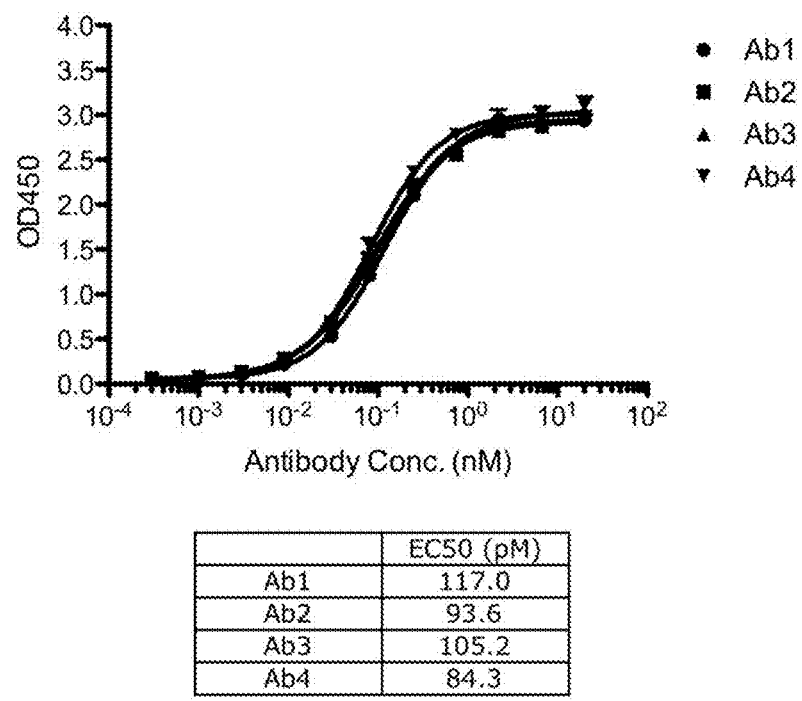
Figure 13. Recognition of human PCSK9 by PCSK9 antibodies Ab1-Ab4.

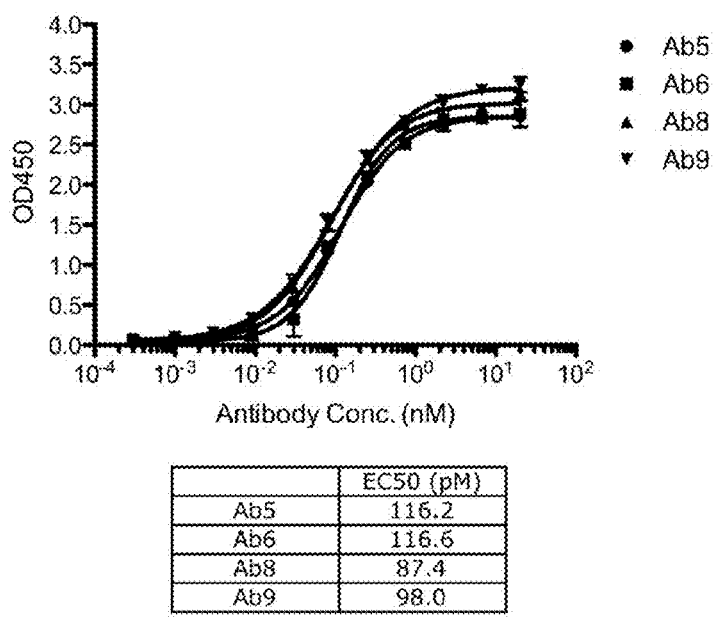
Figure 14. Recognition of human PCSK9 by PCSK9 antibodies Ab5, Ab6, Ab8, and Ab9.

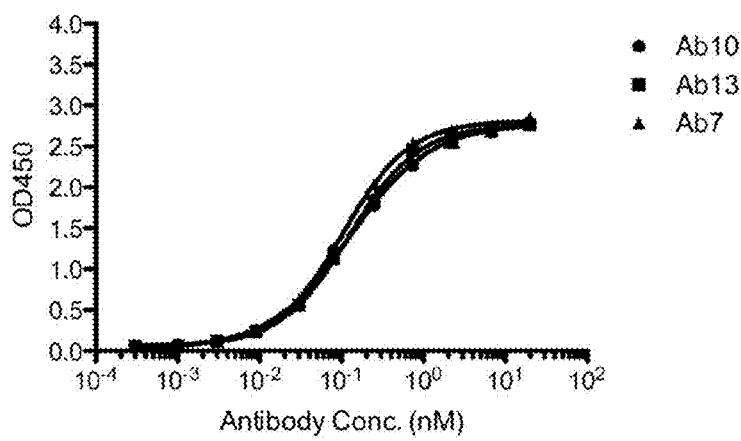
Figure 15. Recognition of human PCSK9 by PCSK9 antibodies Ab7, Ab10, and Ab13.

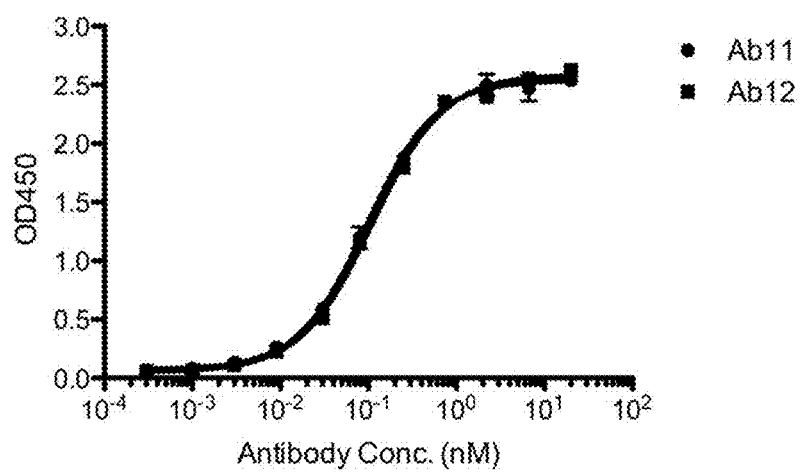
Figure 16. Recognition of human PCSK9 by PCSK9 antibodies Ab11 and Ab12.

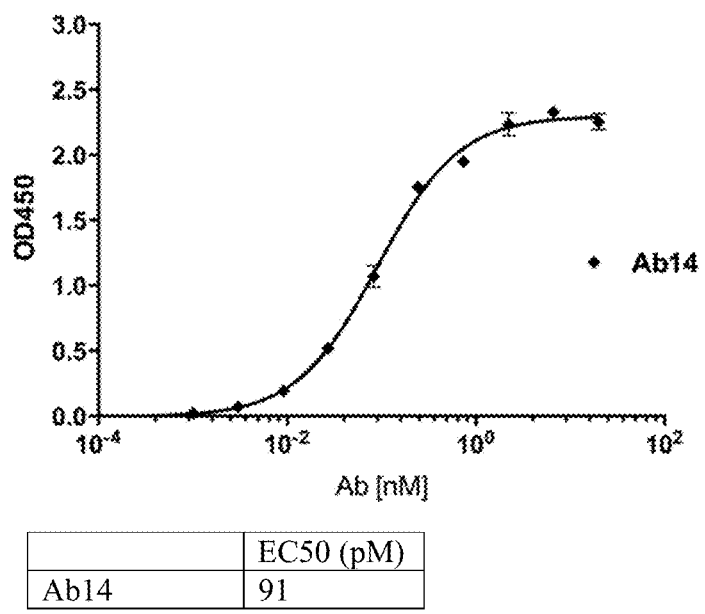
Figure 17. Recognition of human PCSK9 by PCSK9 antibody Ab14.

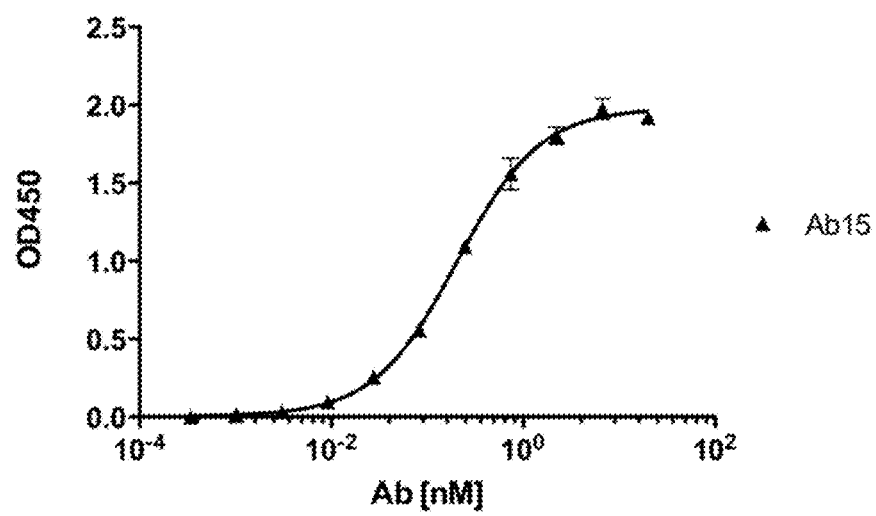
Figure 18. Recognition of human PCSK9 by PCSK9 antibody Ab15.

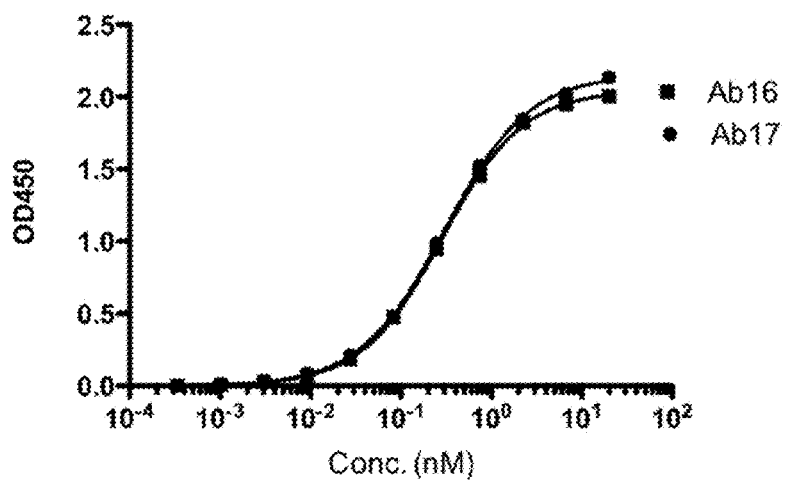
Figure 19. Recognition of human PCSK9 by PCSK9 antibodies Ab16 and Ab17.

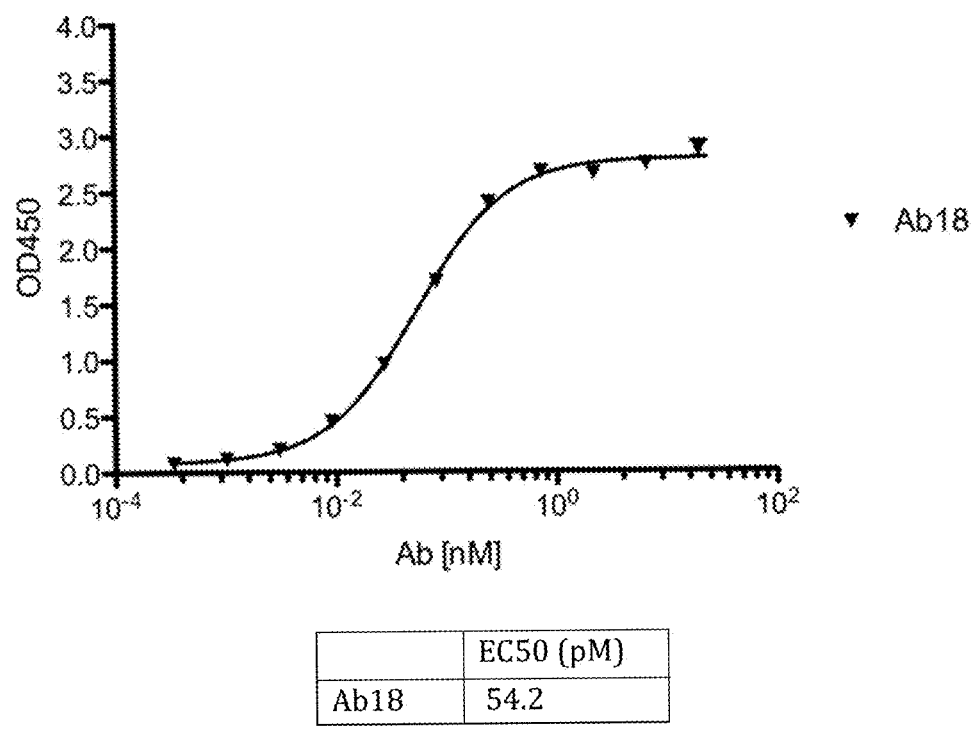
Figure 20. Recognition of human PCSK9 by PCSK9 antibody Ab18.

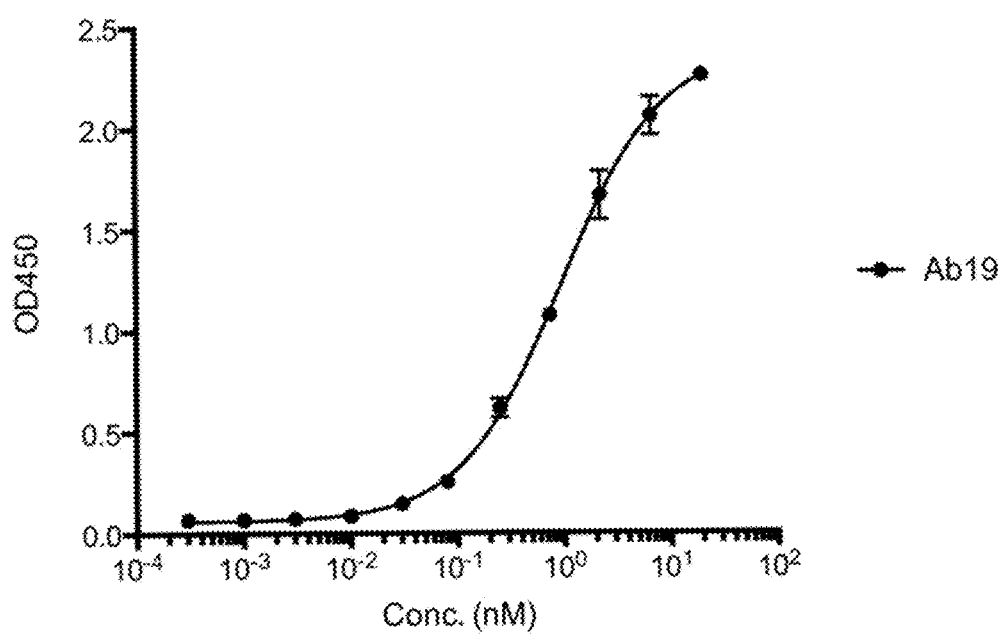
Figure 21. Recognition of human PCSK9 by PCSK9 antibodies Ab19

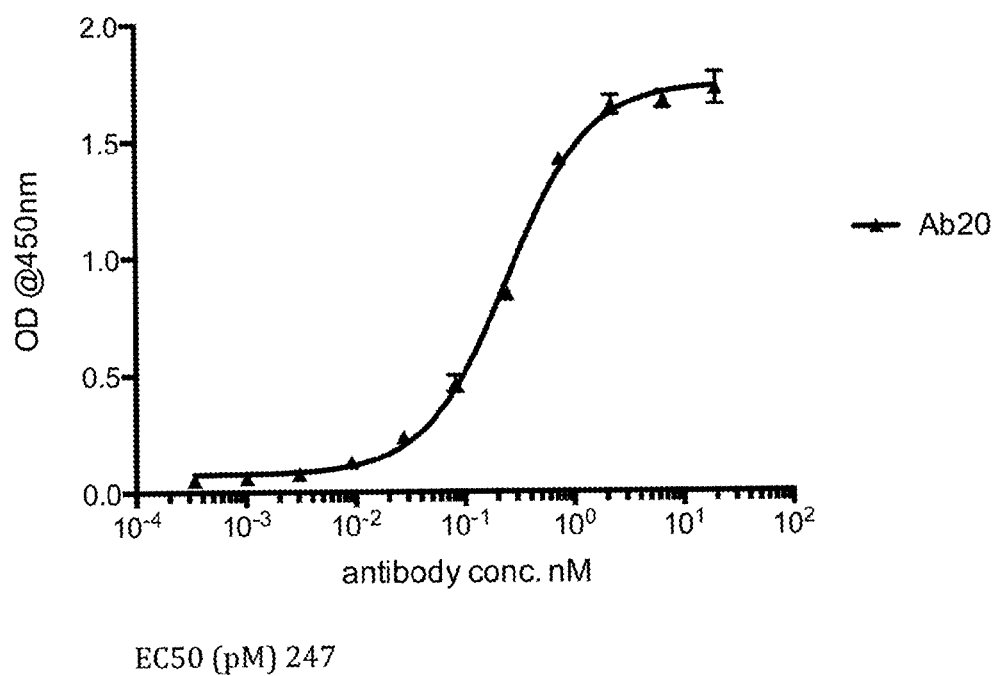
Figure 22. Recognition of human PCSK9 by PCSK9 antibodies Ab20

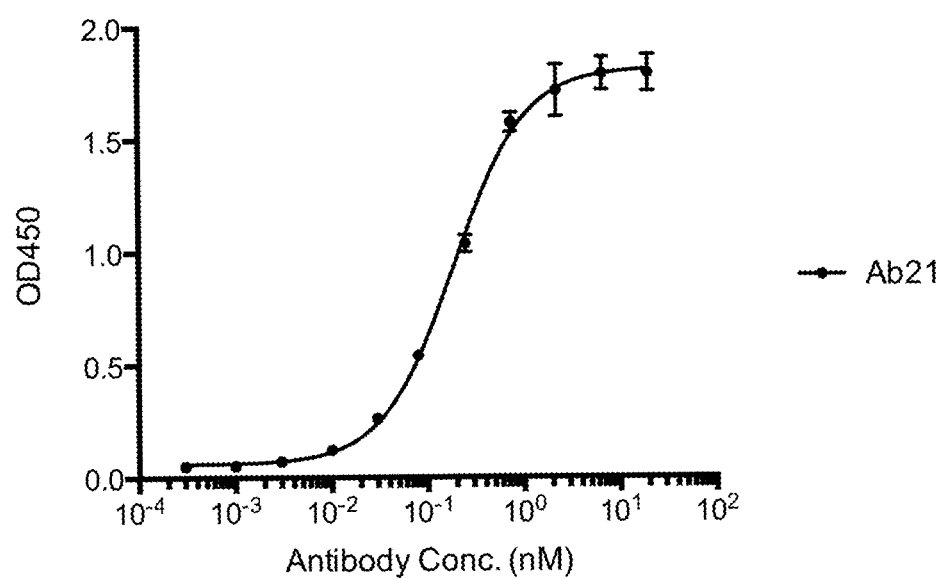
Figure 23. Recognition of human PCSK9 by PCSK9 antibody Ab21.

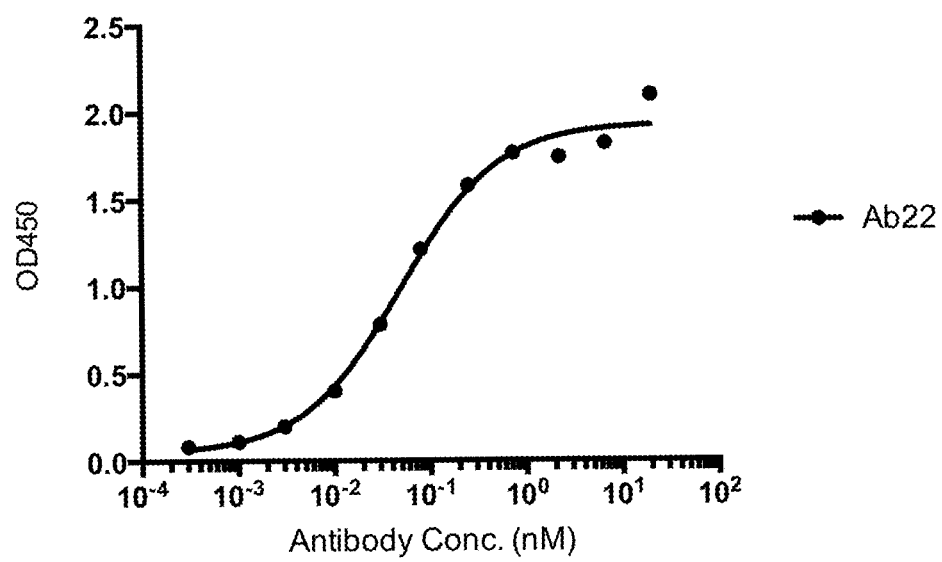
Figure 24. Recognition of human PCSK9 by PCSK9 antibody Ab22.

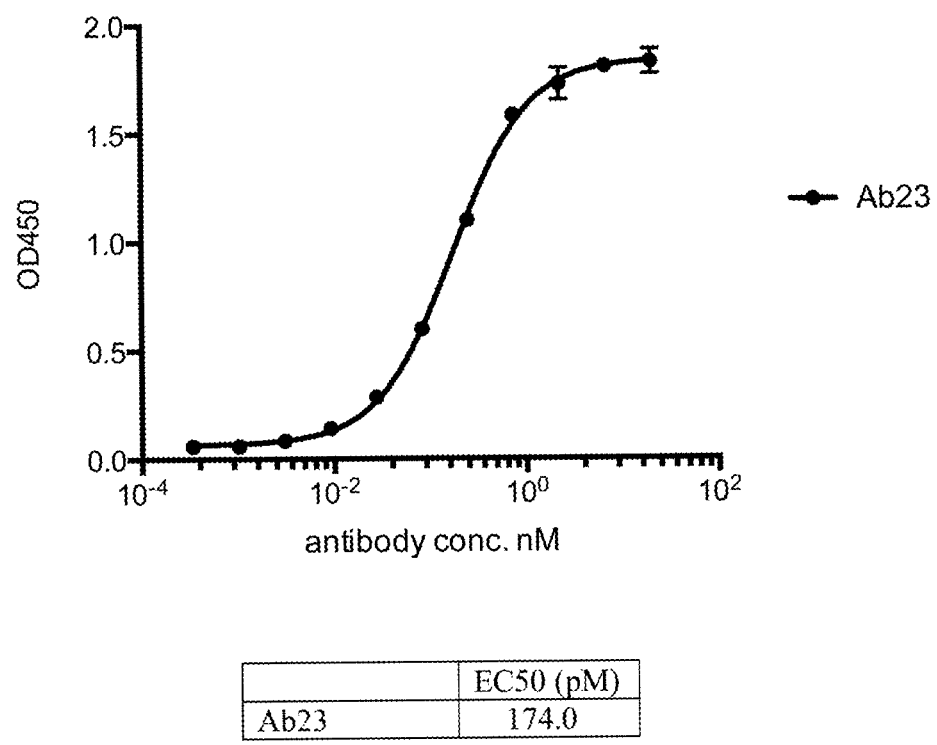
Figure 25. Recognition of human PCSK9 by PCSK9 antibody Ab23.

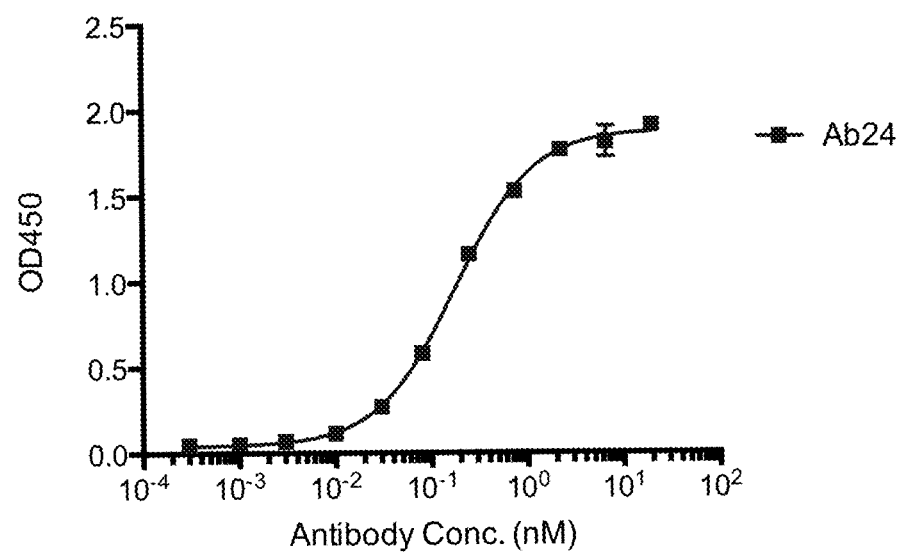
Figure 26. Recognition of human PCSK9 by PCSK9 antibody Ab24.

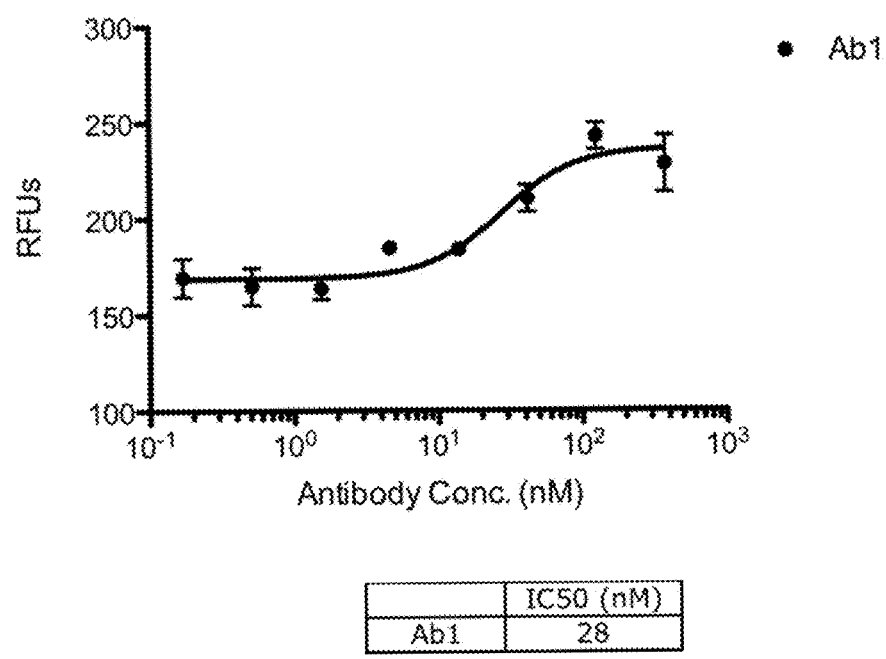
Figure 27. LDL uptake inhibition with antibody Ab1.

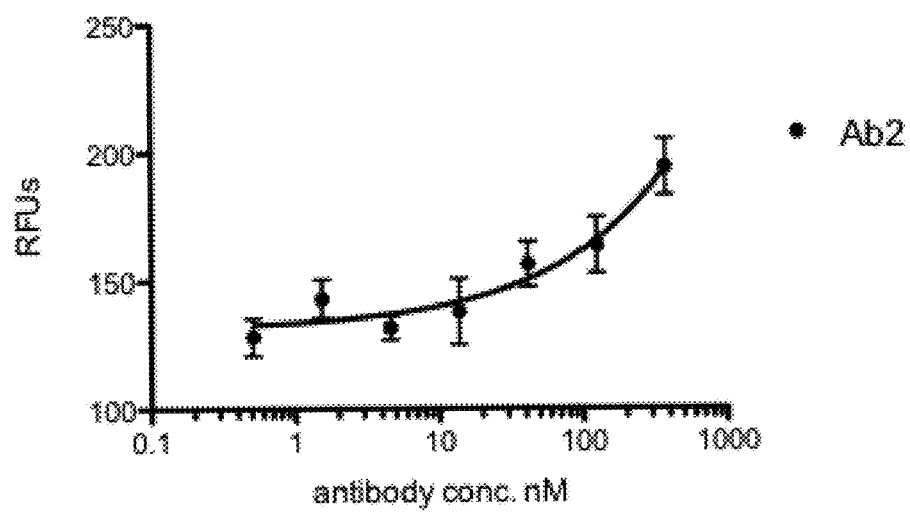
Figure 28. LDL uptake inhibition with antibody Ab2.

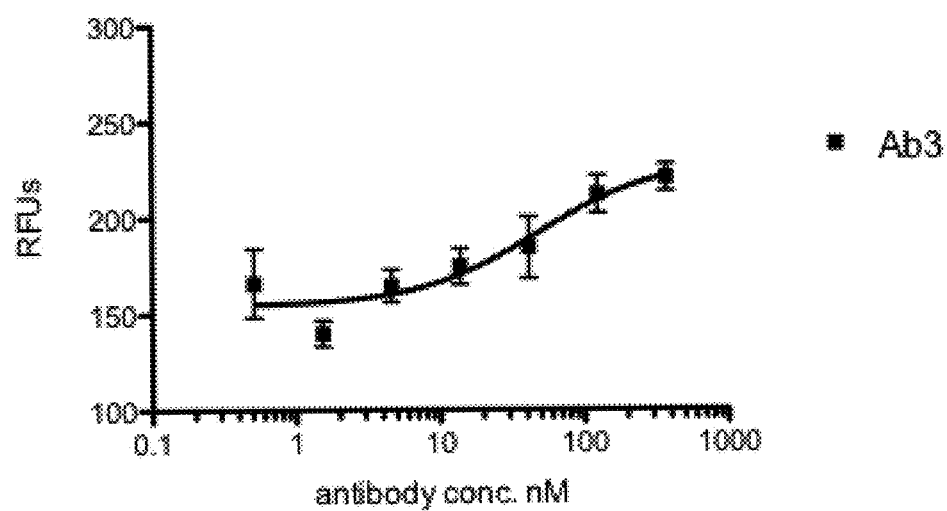
Figure 29. LDL uptake inhibition with antibody Ab3.

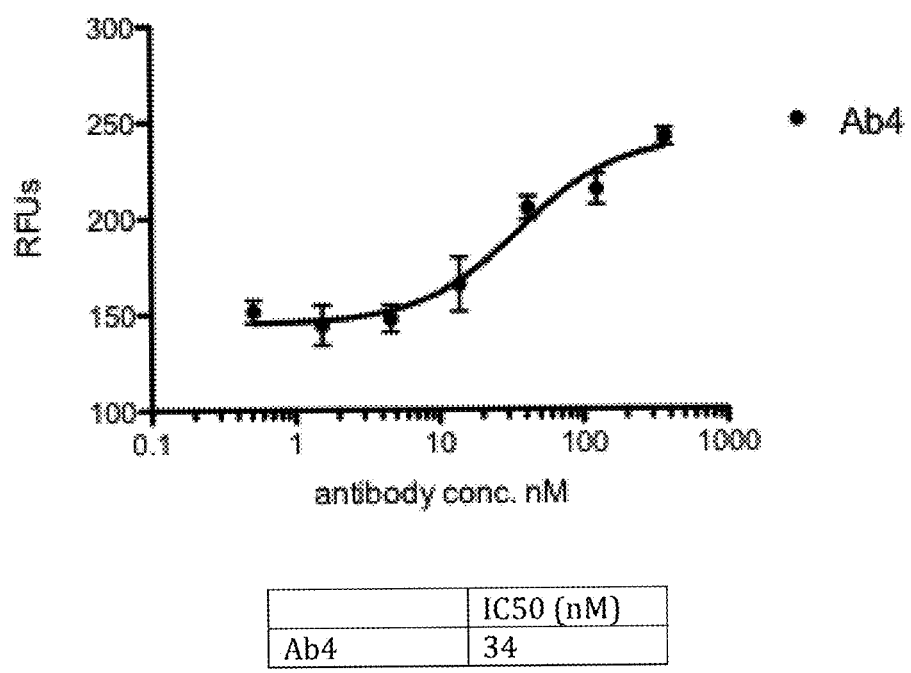
Figure 30. LDL uptake inhibition with antibody Ab4.

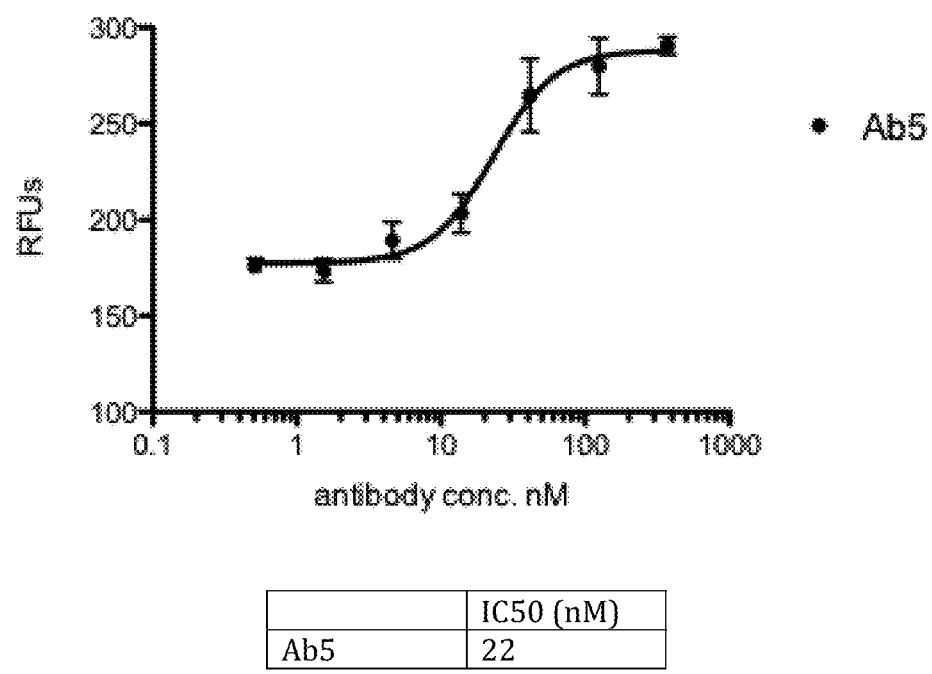
Figure 31. LDL uptake inhibition with antibody Ab5.

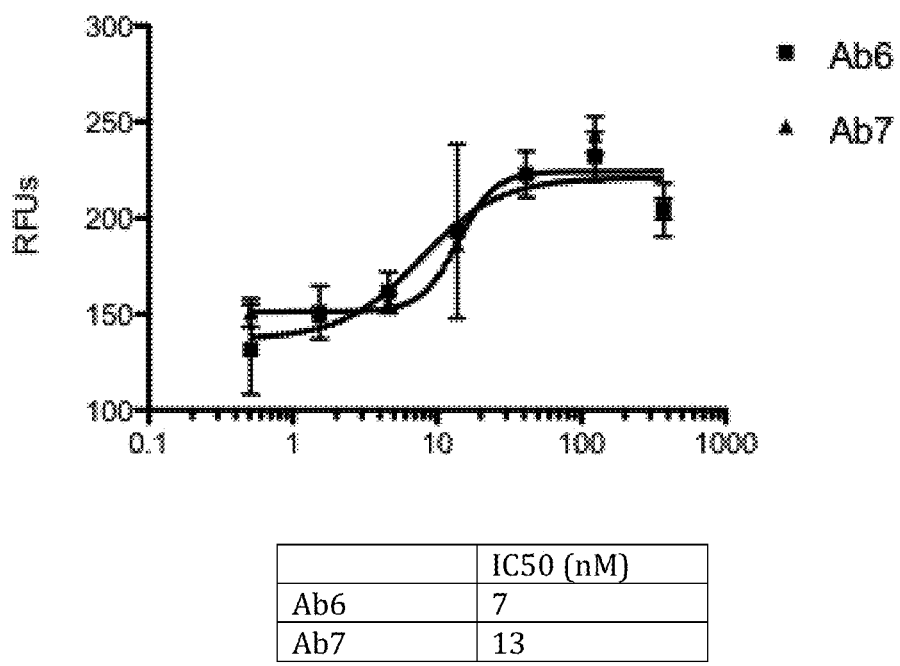
Figure 32. LDL uptake inhibition with antibodies Ab6 and Ab7.

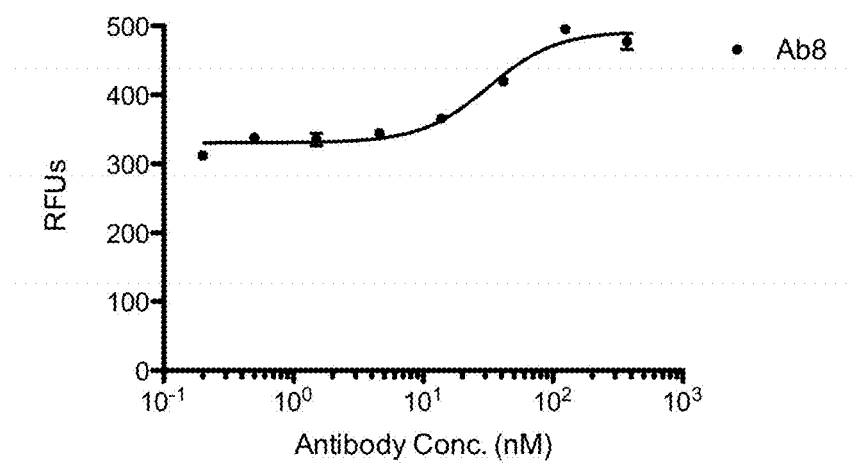
Figure 33. LDL uptake inhibition with antibody Ab8.

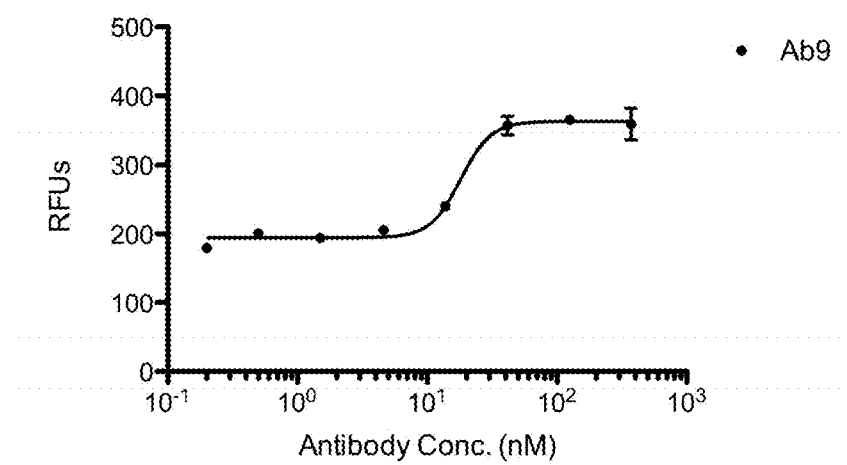
Figure 34. LDL uptake inhibition with antibody Ab9.

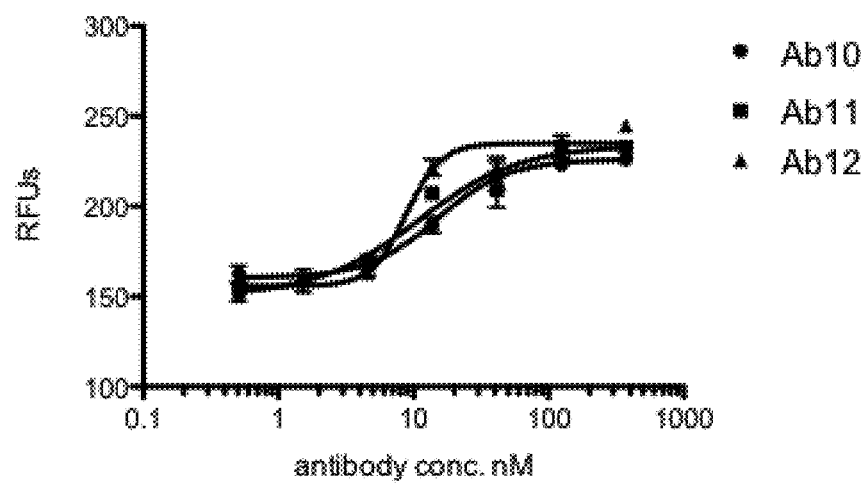
Figure 35. LDL uptake inhibition with antibodies Ab10, Ab11, and Ab12.

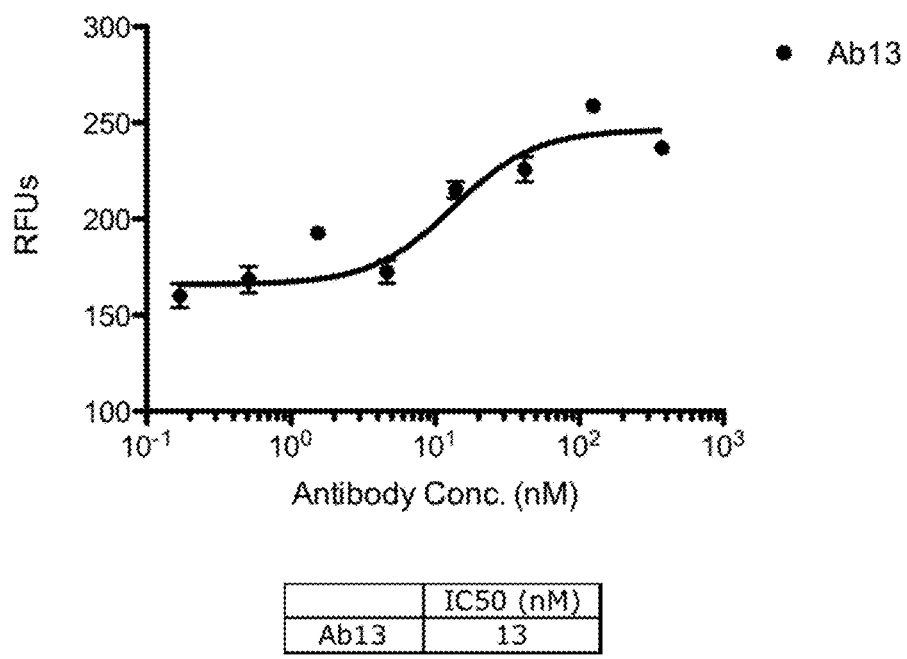
Figure 36. LDL uptake inhibition with antibody Ab13.

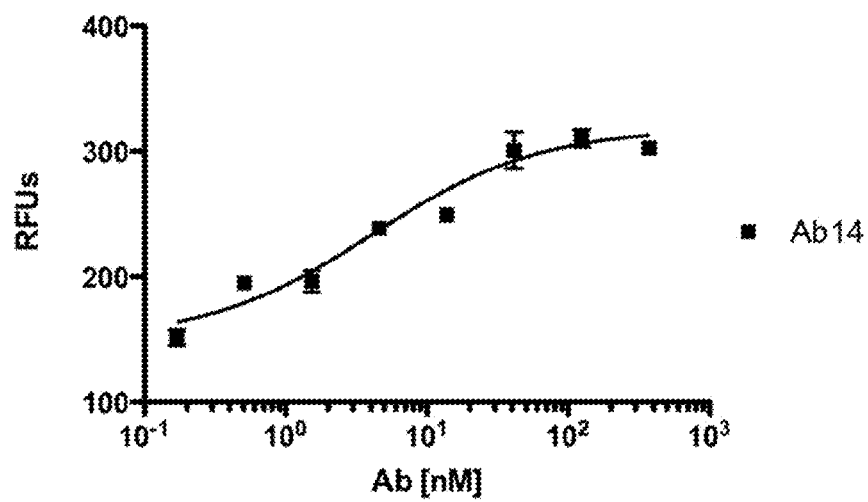
Figure 37. LDL uptake inhibition with antibody Ab14.

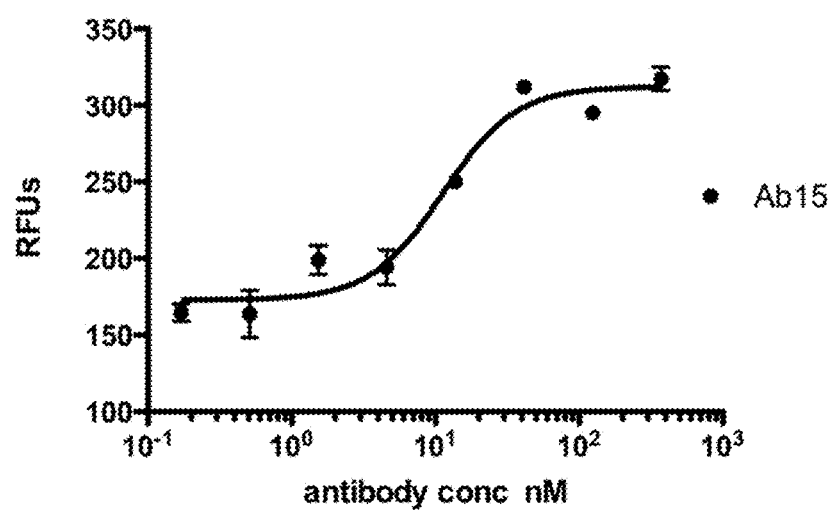
Figure 38. LDL uptake inhibition with antibody Ab15.

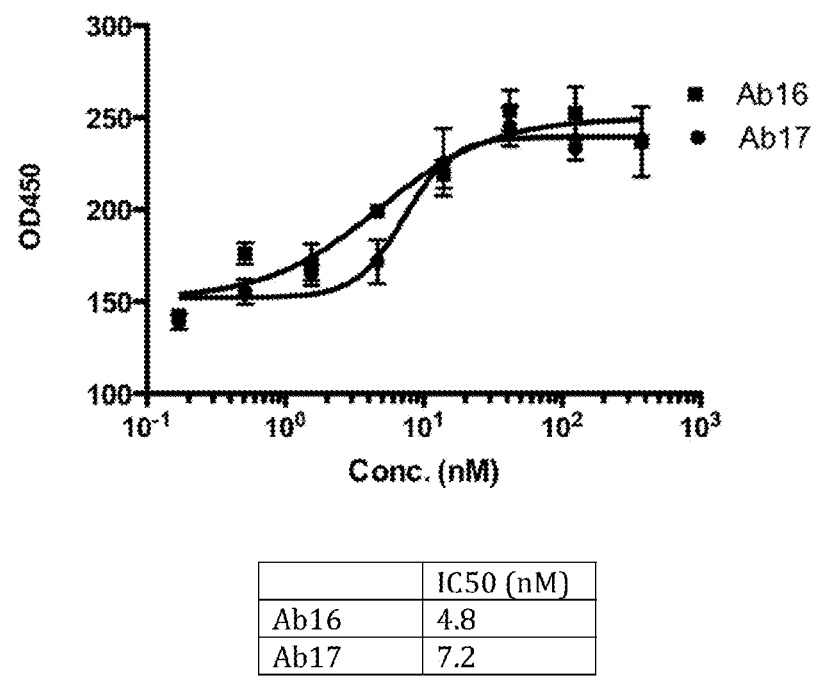
Figure 39. LDL uptake inhibition with antibodies Ab16 and Ab17.

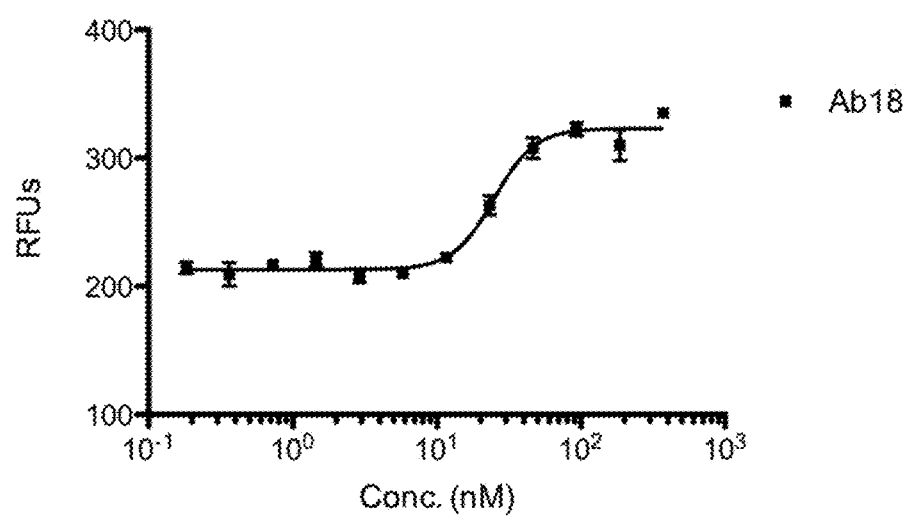
Figure 40. LDL uptake inhibition with antibody Ab18.

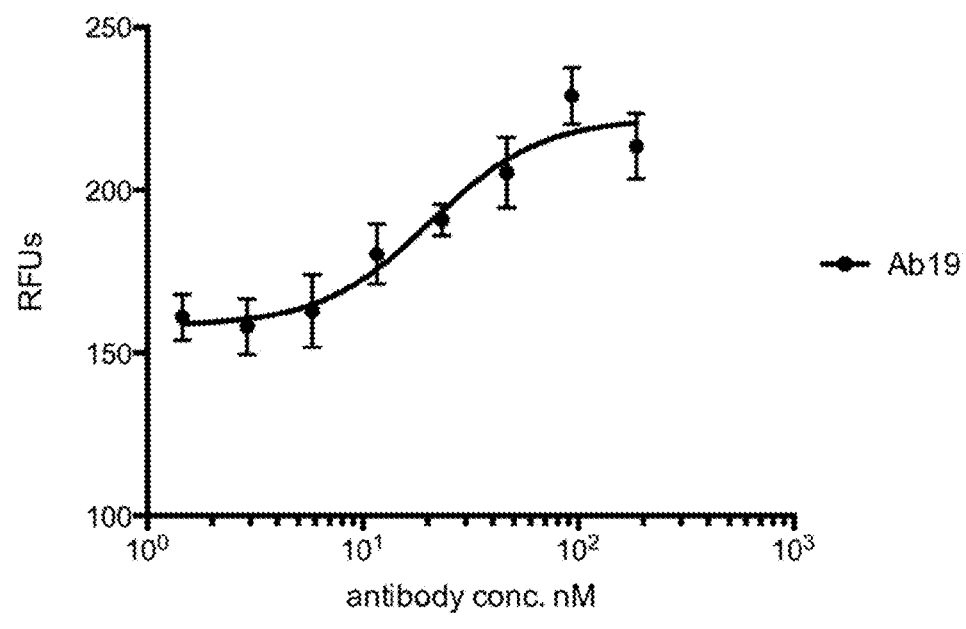
IC50 20.6nM
Figure 41. LDL uptake inhibition with antibody Ab19.

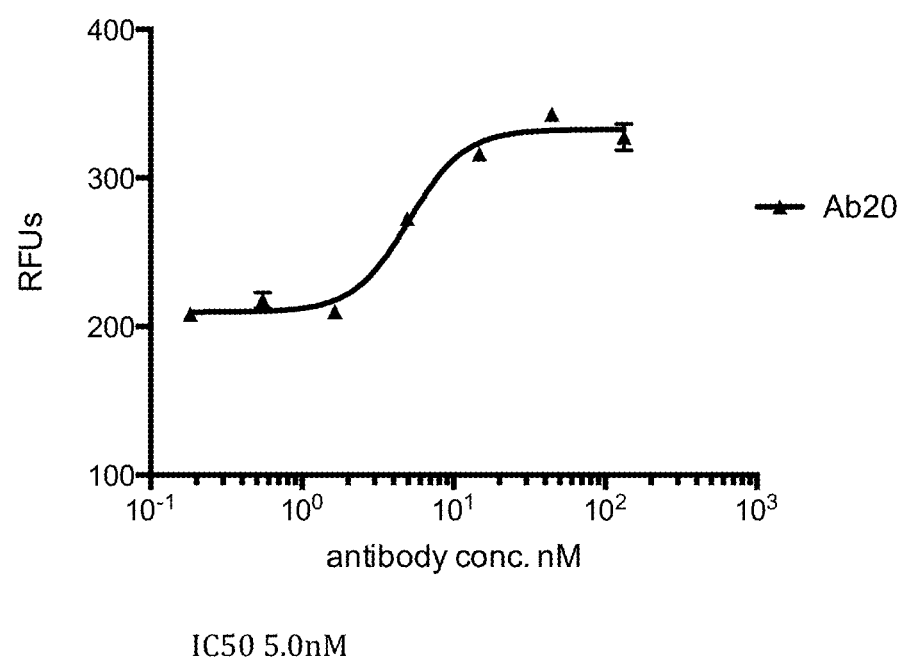
IC50 5.0nM
Figure 42. LDL uptake inhibition with antibody Ab20.

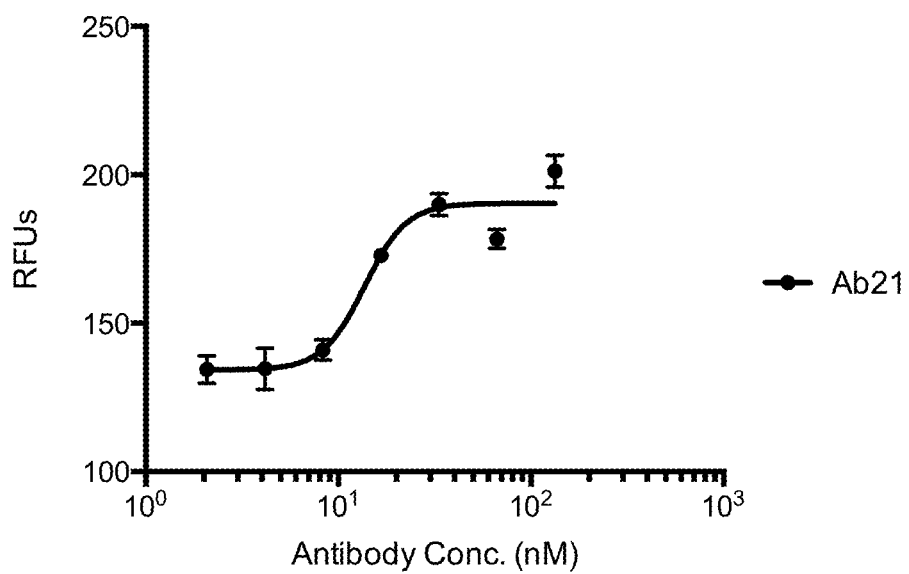
Figure 43. LDL uptake inhibition with antibody Ab21.

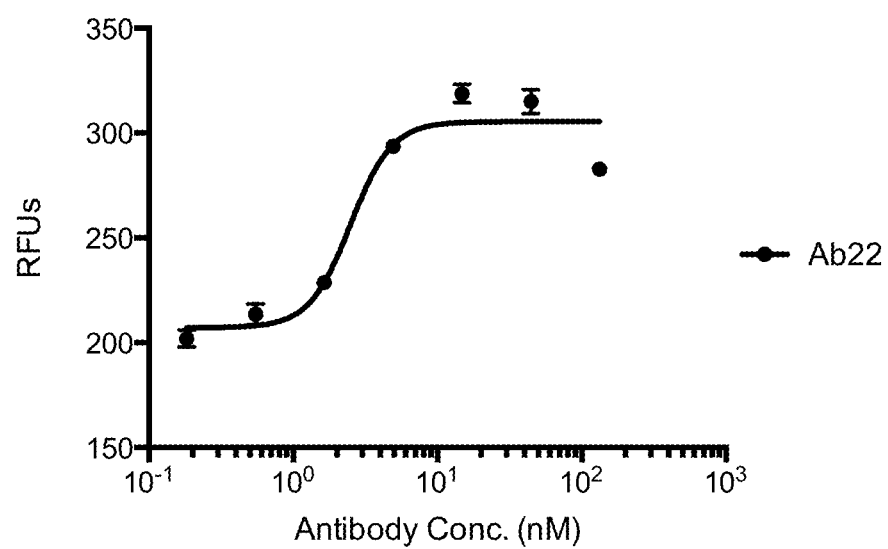
Figure 44. LDL uptake inhibition with antibody Ab22.

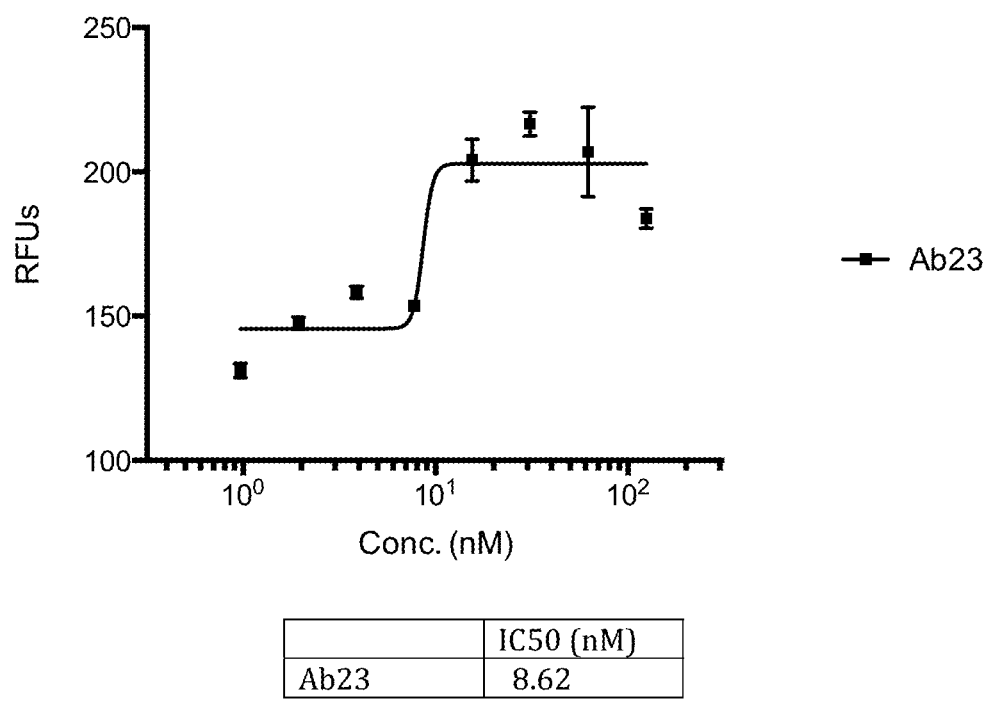
Figure 45. LDL uptake inhibition with antibody Ab23.

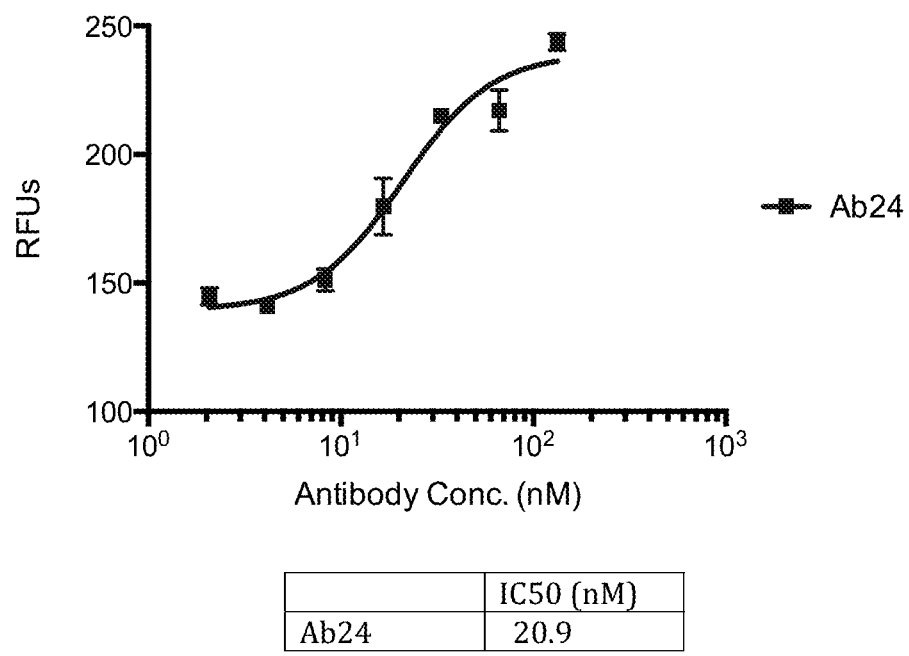
Figure 46. LDL uptake inhibition with antibody Ab24.

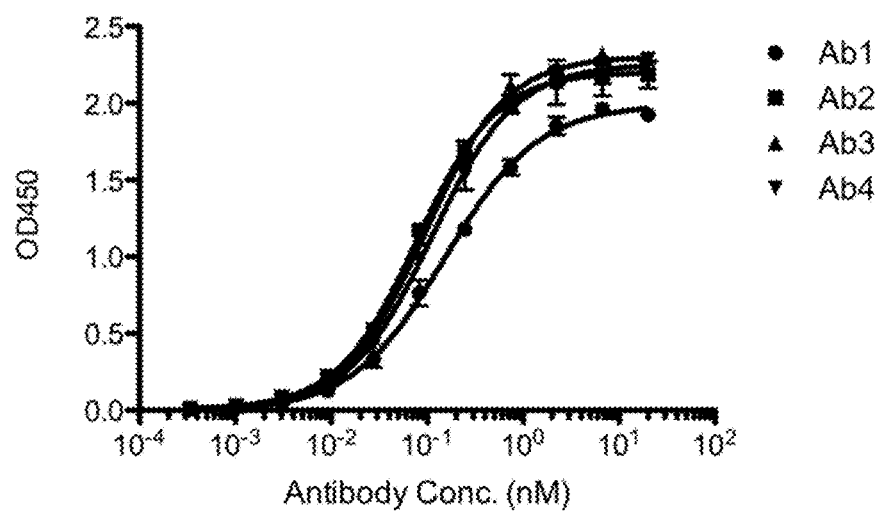
Figure 47. Recognition of cynomolgus monkey PCSK9 by PCSK9 antibodies Ab1-Ab4.

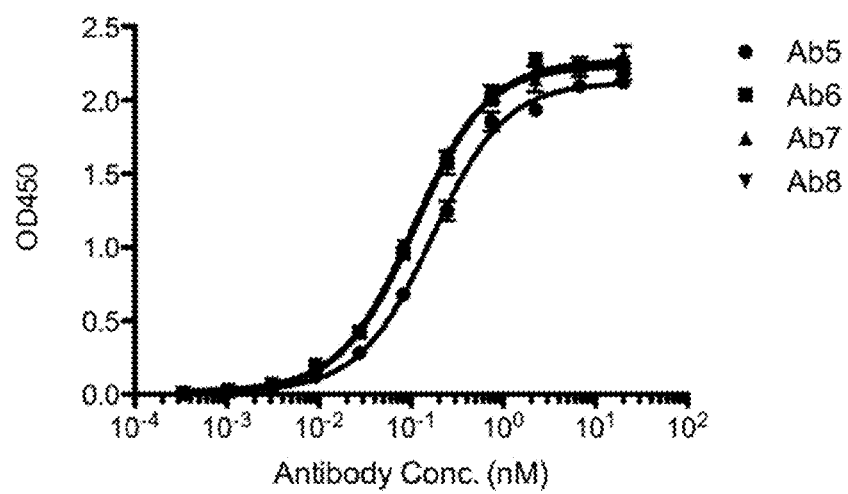
Figure 48. Recognition of cynomolgus monkey PCSK9 by PCSK9 antibodies Ab5, Ab6, Ab7, and Ab8.

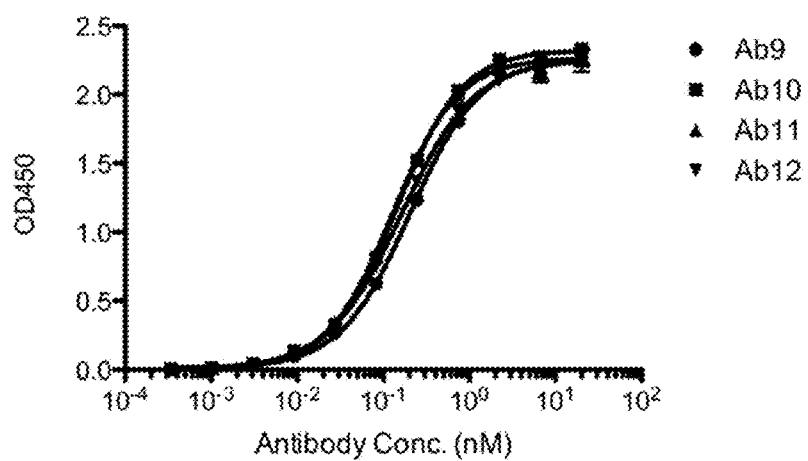
Figure 49. Recognition of cynomolgus monkey PCSK9 by PCSK9 antibodies Ab9, Ab10, Ab11, and Ab12.

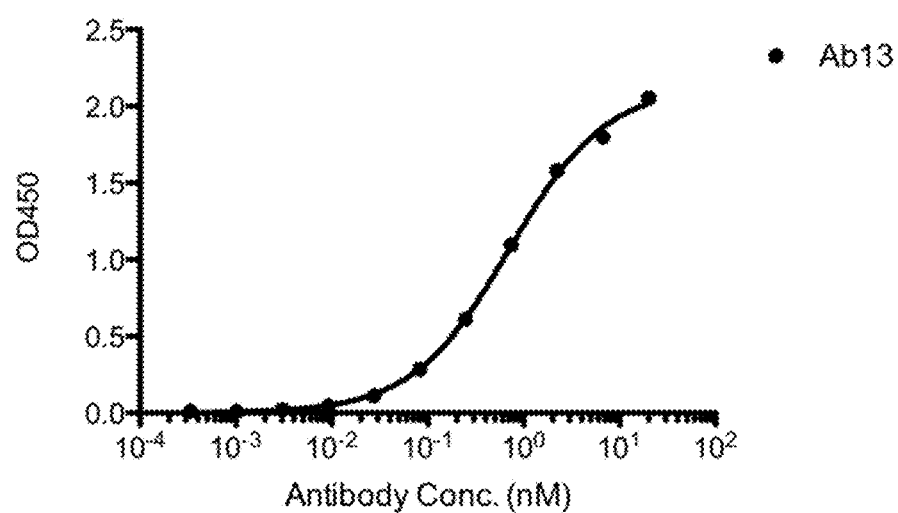
Figure 50. Recognition of cynomolgus monkey PCSK9 by PCSK9 antibody Ab13.

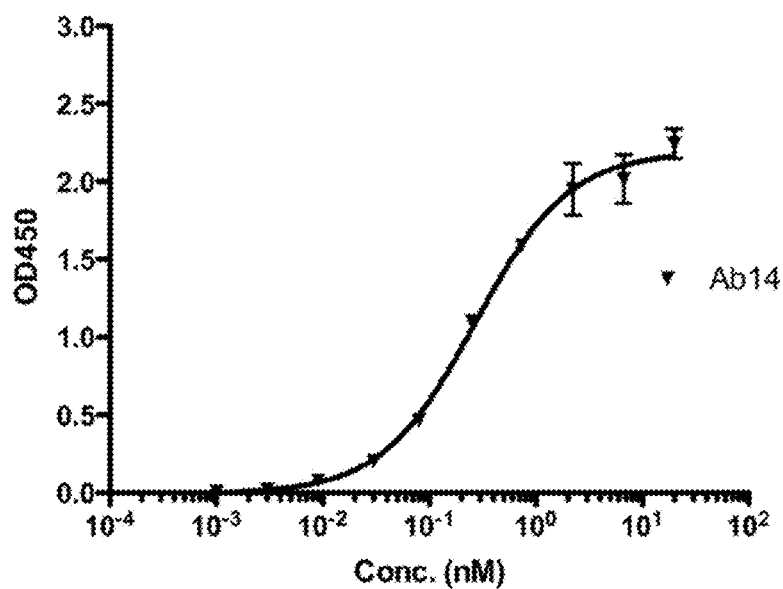
Figure 51. Recognition of cynomolgus monkey PCSK9 by PCSK9 antibody Ab14.

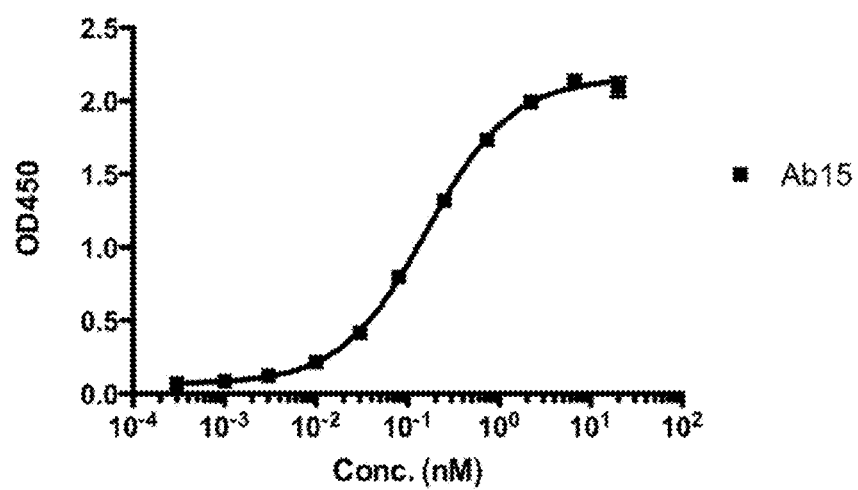
Figure 52. Recognition of cynomolgus monkey PCSK9 by PCSK9 antibody Ab15.

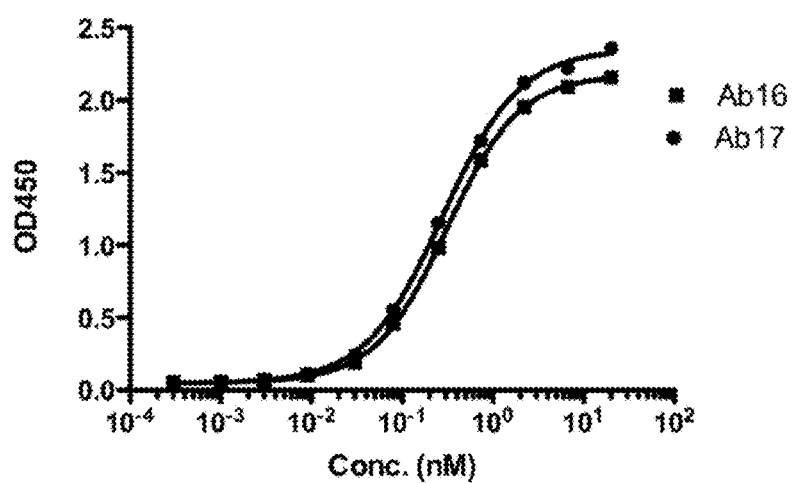
Figure 53. Recognition of cynomolgus monkey PCSK9 by PCSK9 antibodies Ab16 and Ab17.

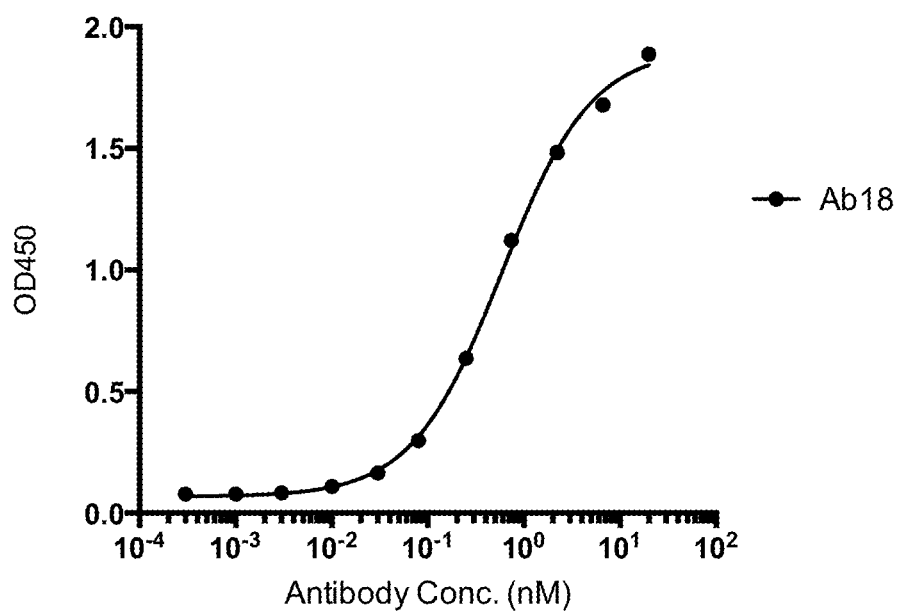
Figure 54. Recognition of cynomolgus monkey PCSK9 by PCSK9 antibody Ab18.

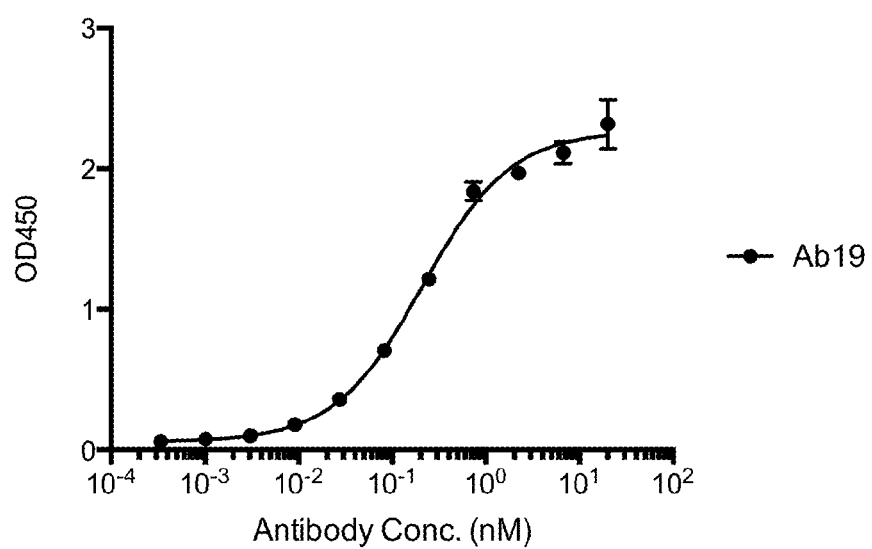
Figure 55. Recognition of cynomolgus monkey PCSK9 by PCSK9 antibody Ab19.

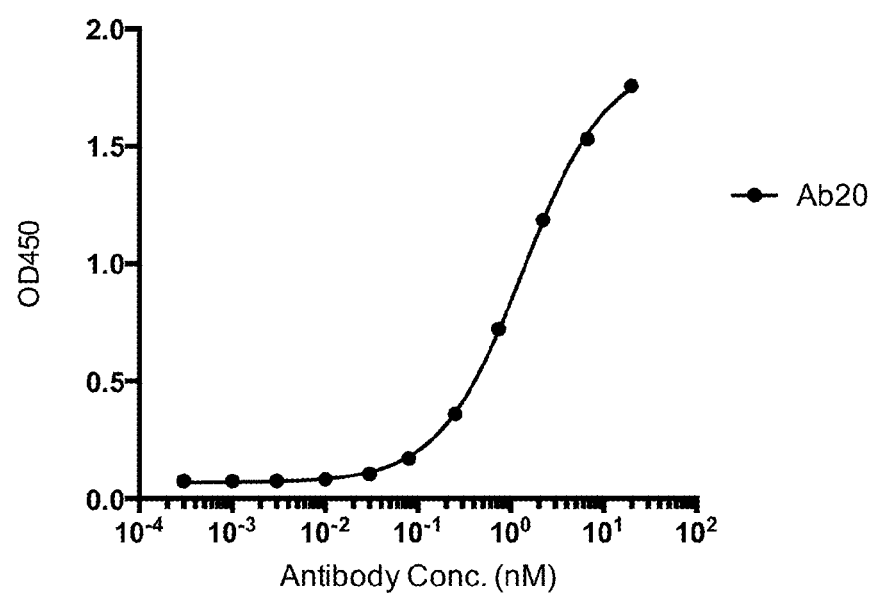
Figure 56. Recognition of cynomolgus monkey PCSK9 by PCSK9 antibody Ab20.

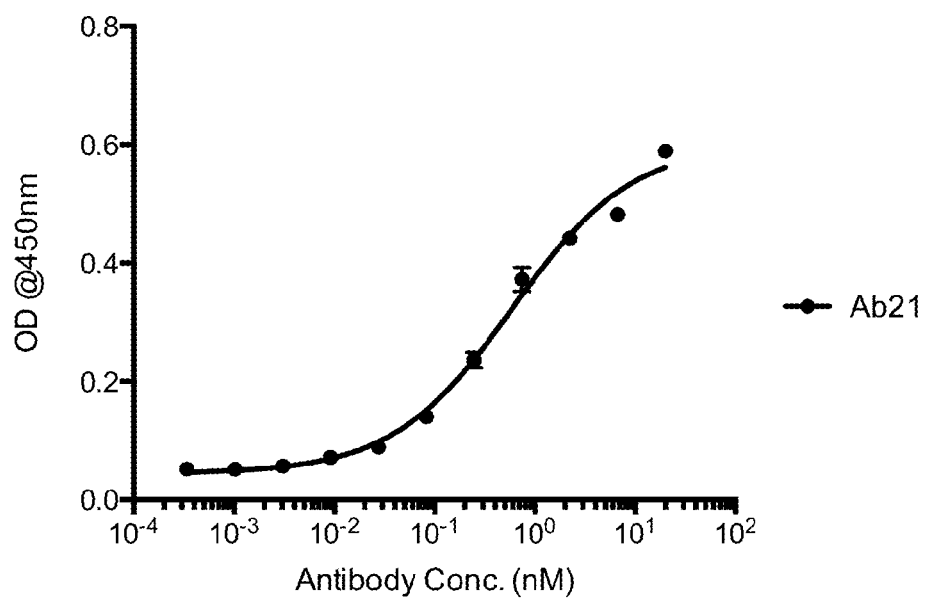
Figure 57. Recognition of cynomolgus monkey PCSK9 by PCSK9 antibody Ab21.

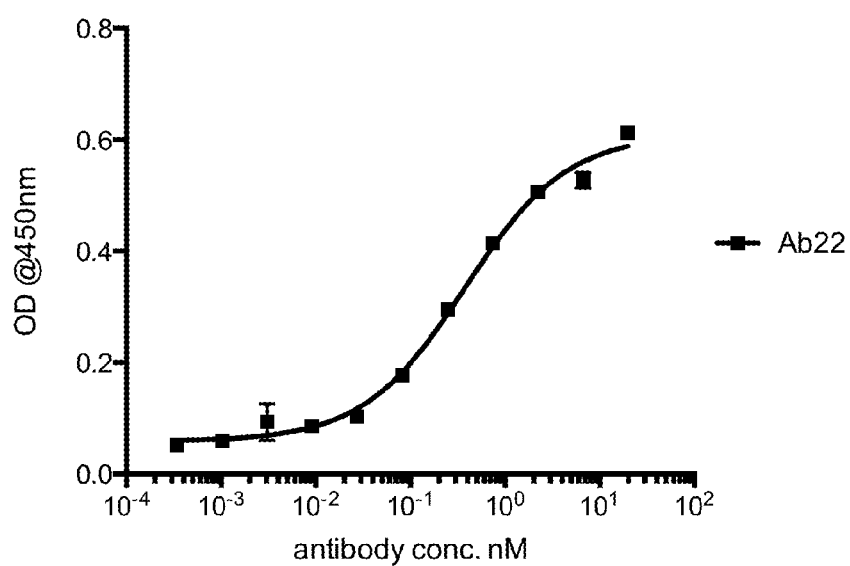
Figure 58. Recognition of cynomolgus monkey PCSK9 by PCSK9 antibody Ab22.

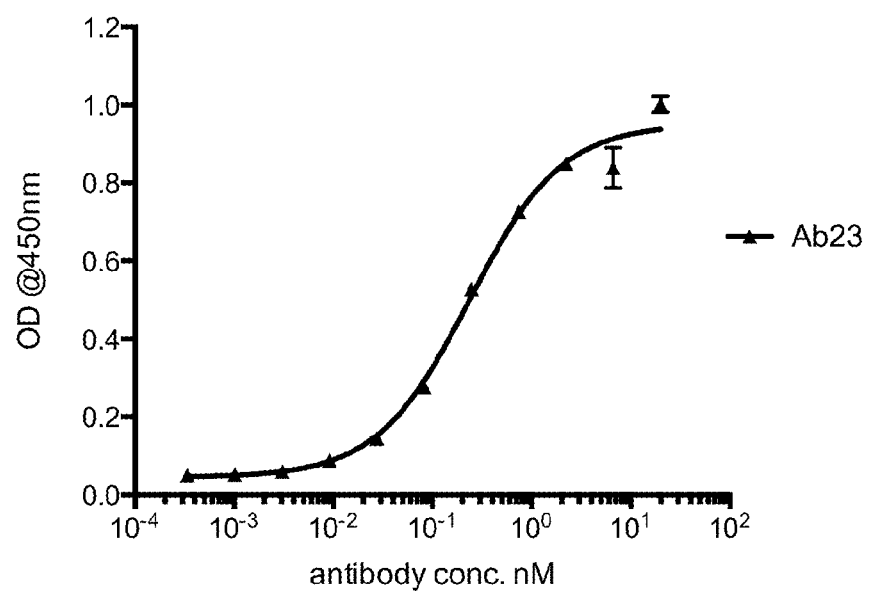
Figure 59. Recognition of cynomolgus monkey PCSK9 by PCSK9 antibody Ab23.

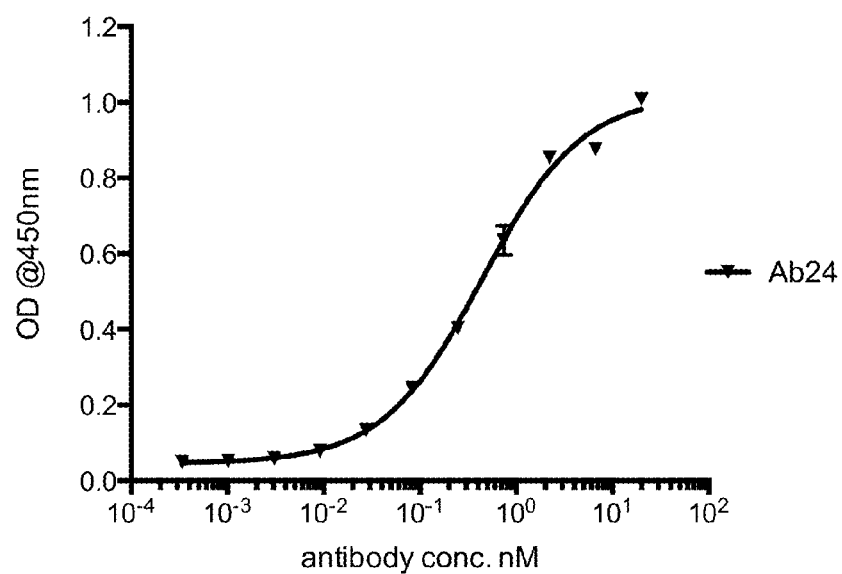
Figure 60. Recognition of cynomolgus monkey PCSK9 by PCSK9 antibody Ab24.

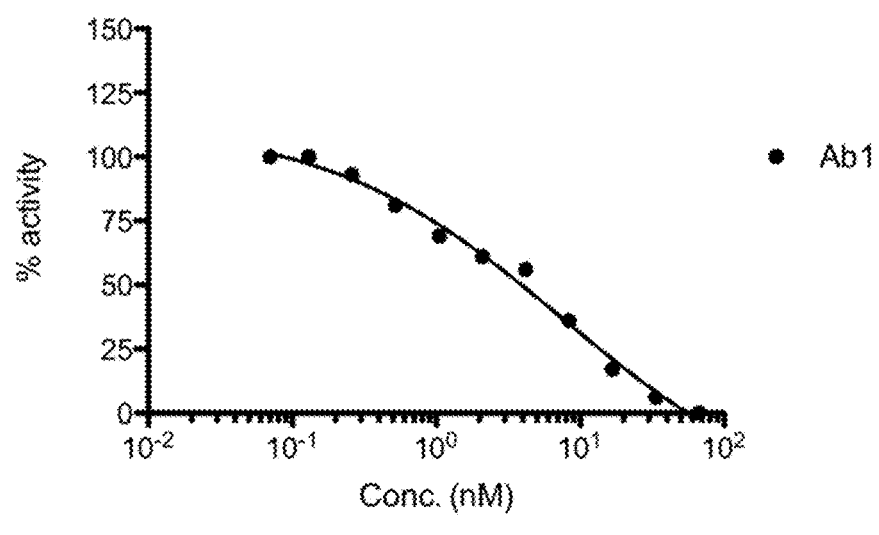
Figure 61. Inhibition of PCSK9 interaction with LDLR by antibody Ab1.

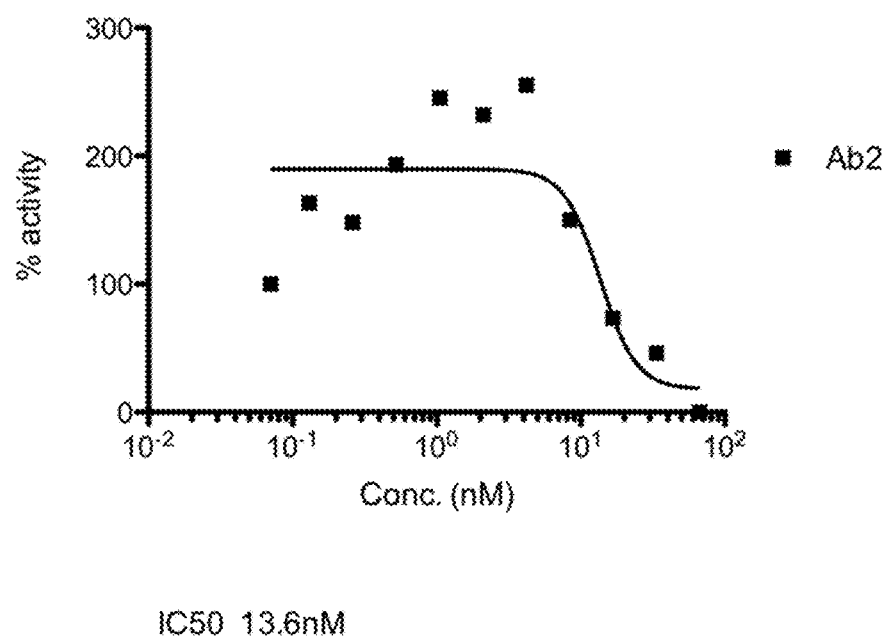
Figure 62. Inhibition of PCSK9 interaction with LDLR by antibody Ab2.

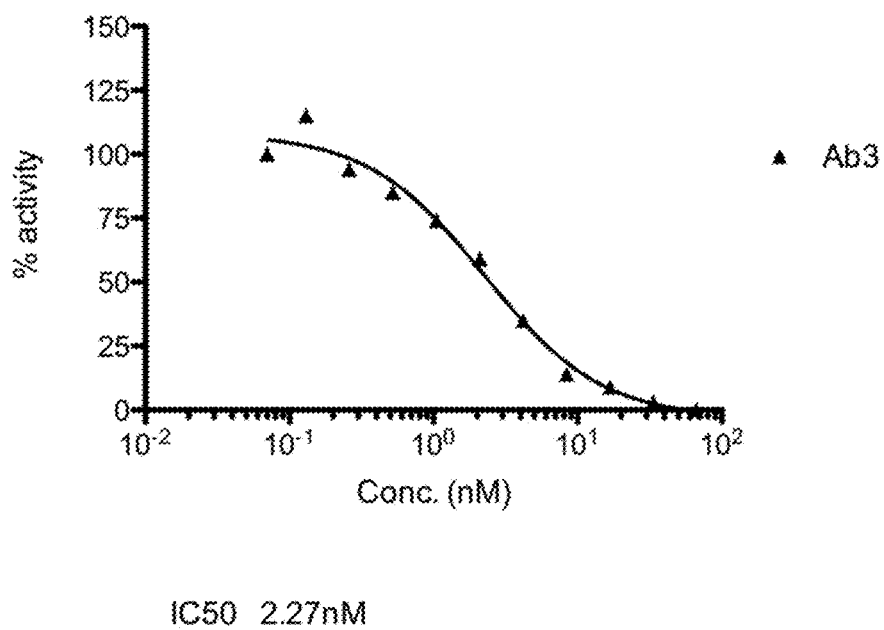
Figure 63. Inhibition of PCSK9 interaction with LDLR by antibody Ab3.

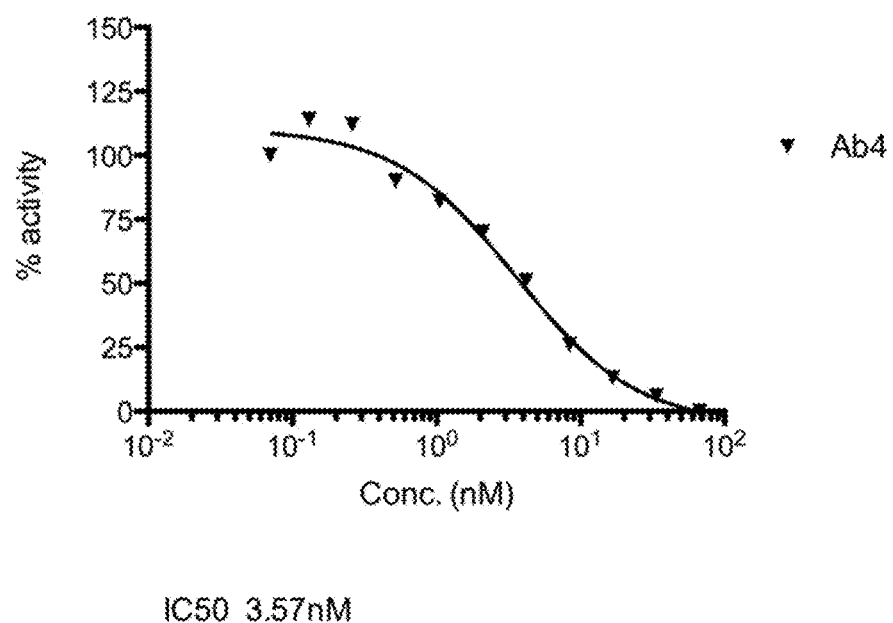
Figure 64. Inhibition of PCSK9 interaction with LDLR by antibody Ab4.

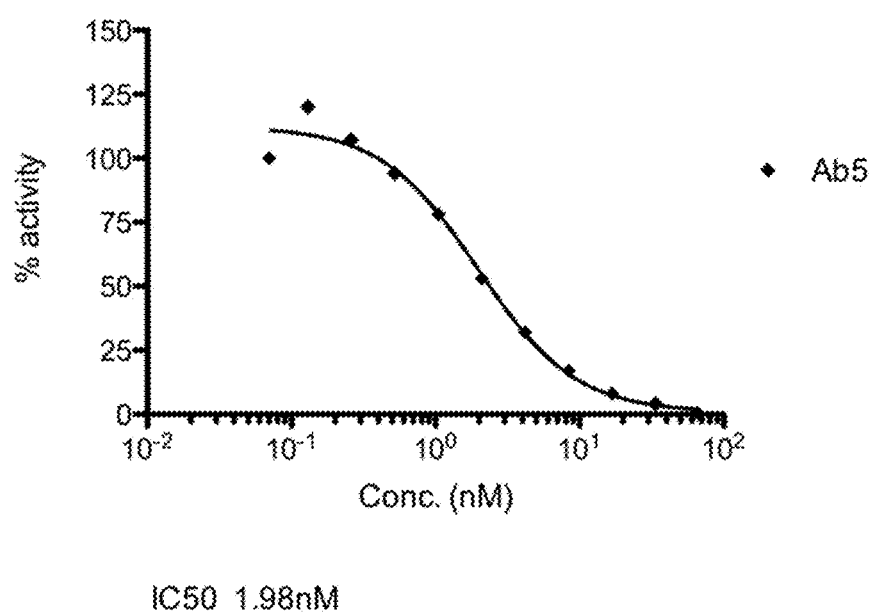
Figure 65. Inhibition of PCSK9 interaction with LDLR by antibody Ab5.

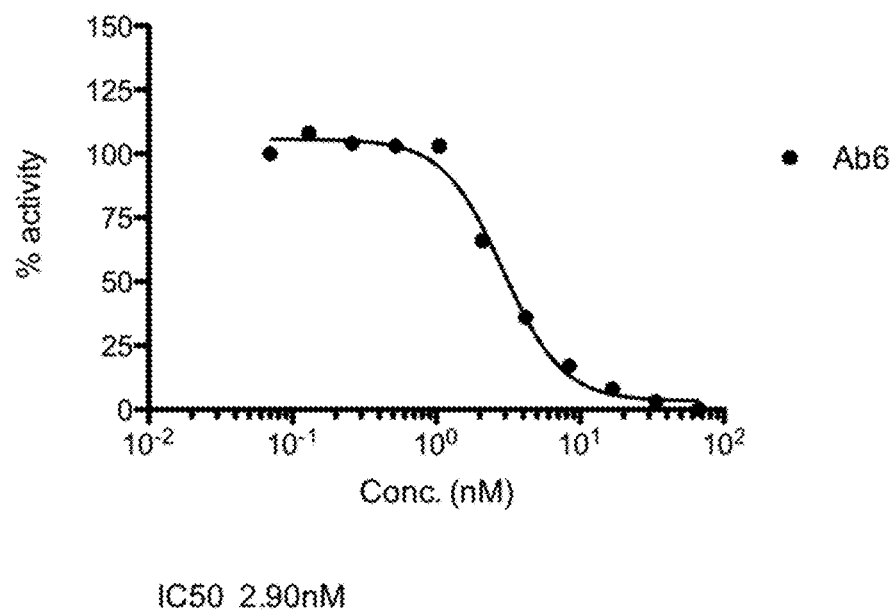
Figure 66. Inhibition of PCSK9 interaction with LDLR by antibody Ab6.

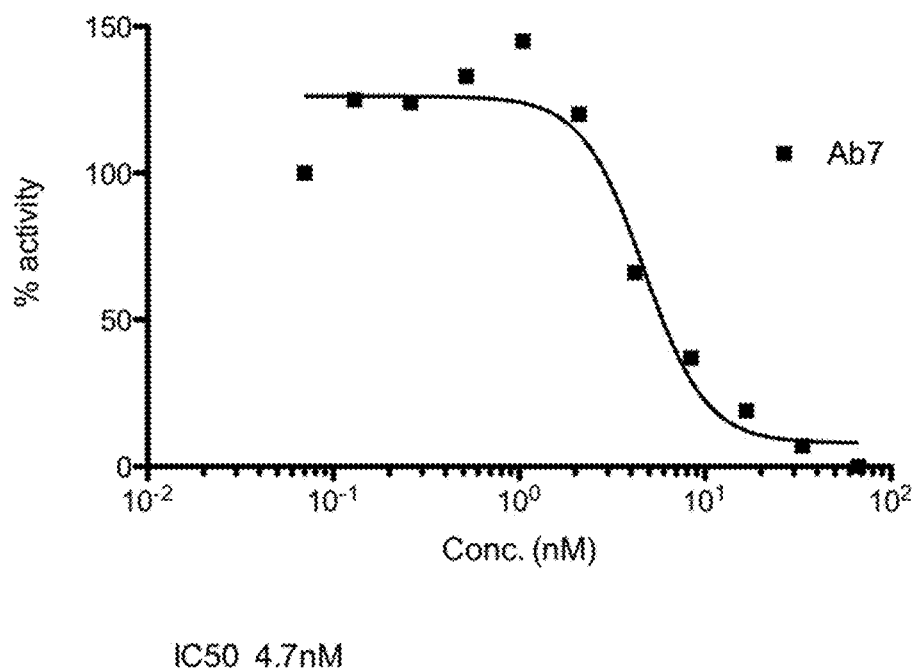
Figure 67. Inhibition of PCSK9 interaction with LDLR by antibody Ab7.

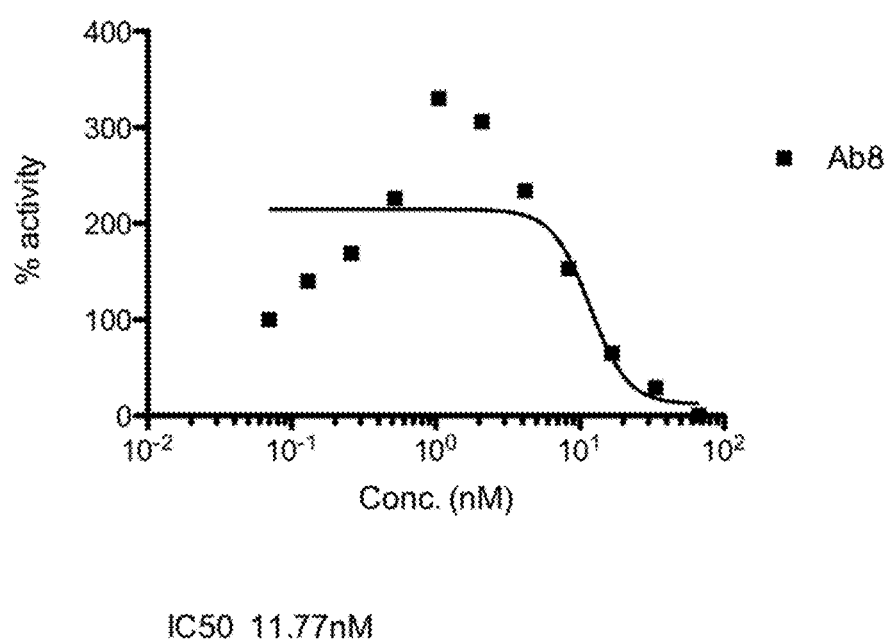
Figure 68. Inhibition of PCSK9 interaction with LDLR by antibody Ab8.

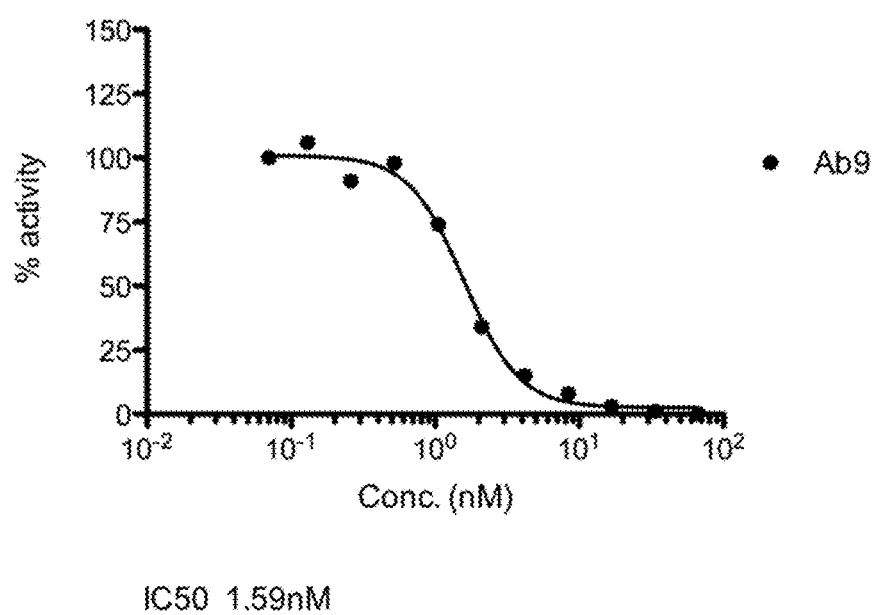
IC50 1.59nM
Figure 69. Inhibition of PCSK9 interaction with LDLR by antibody Ab9.

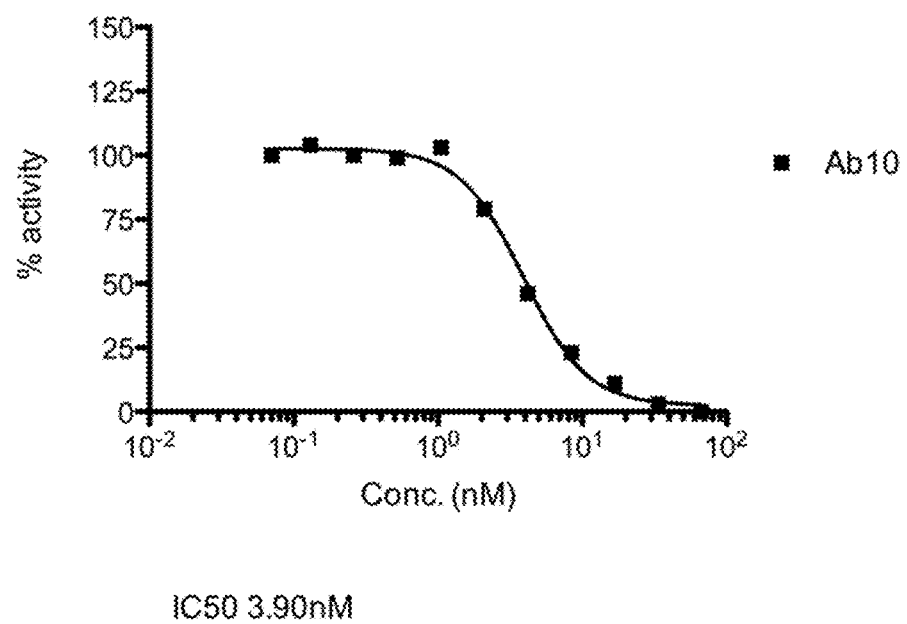
Figure 70. Inhibition of PCSK9 interaction with LDLR by antibody Ab10.

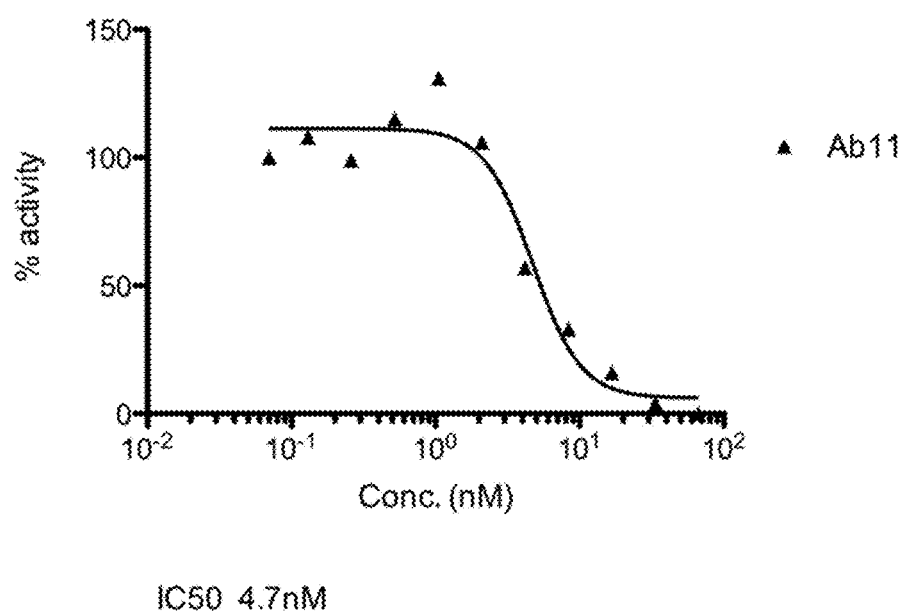
Figure 71. Inhibition of PCSK9 interaction with LDLR by antibody Ab11.

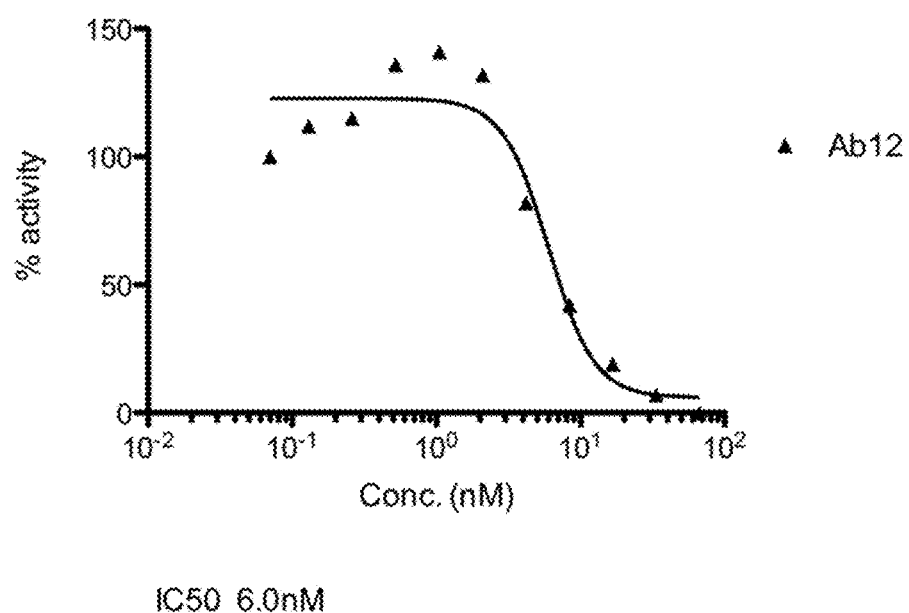
Figure 72. Inhibition of PCSK9 interaction with LDLR by antibody Ab12.

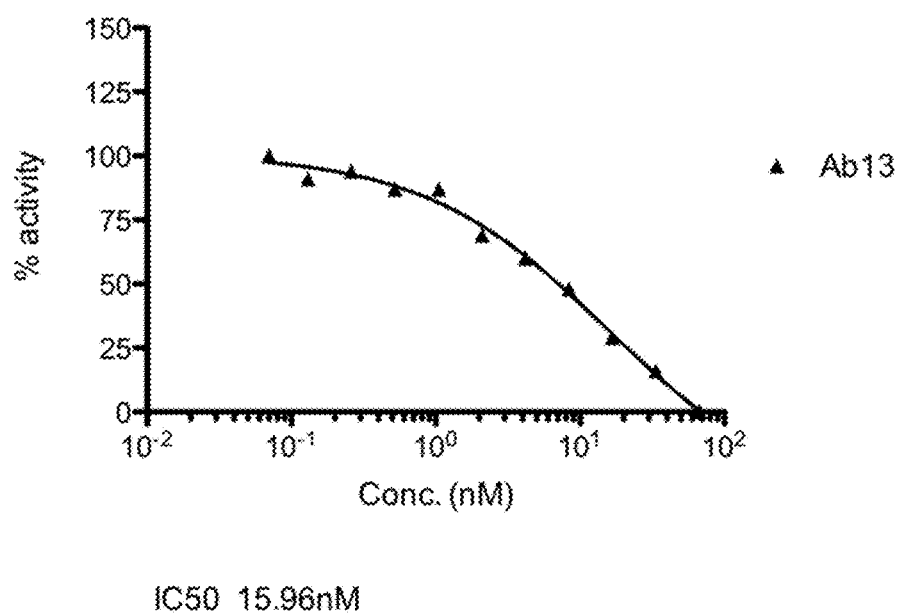
Figure 73. Inhibition of PCSK9 interaction with LDLR by antibody Ab13.

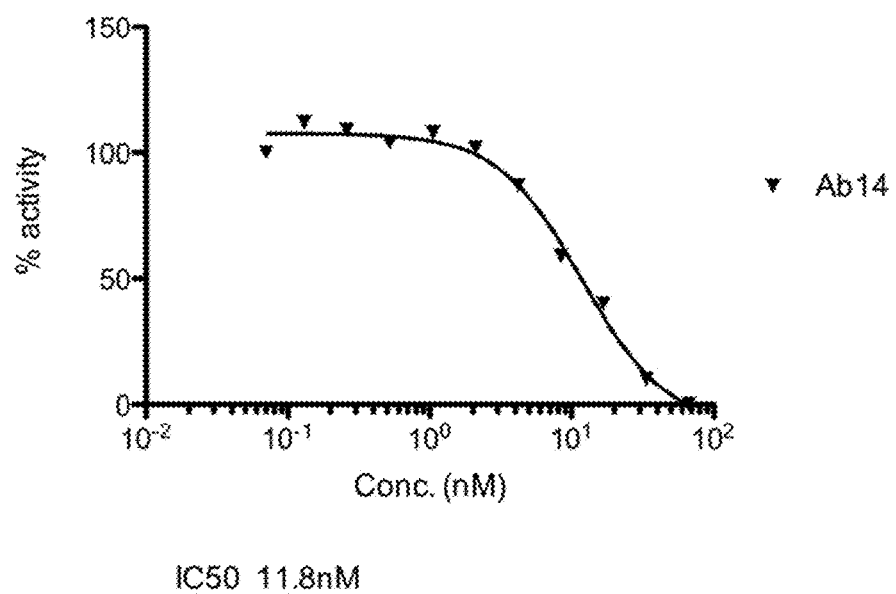
Figure 74. Inhibition of PCSK9 interaction with LDLR by antibody Ab14.

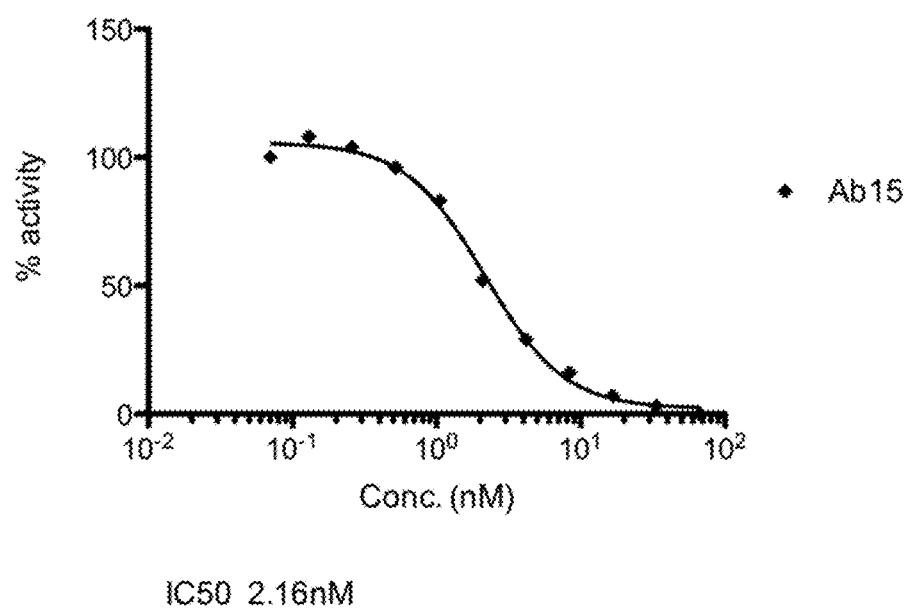
Figure 75. Inhibition of PCSK9 interaction with LDLR by antibody Ab15.

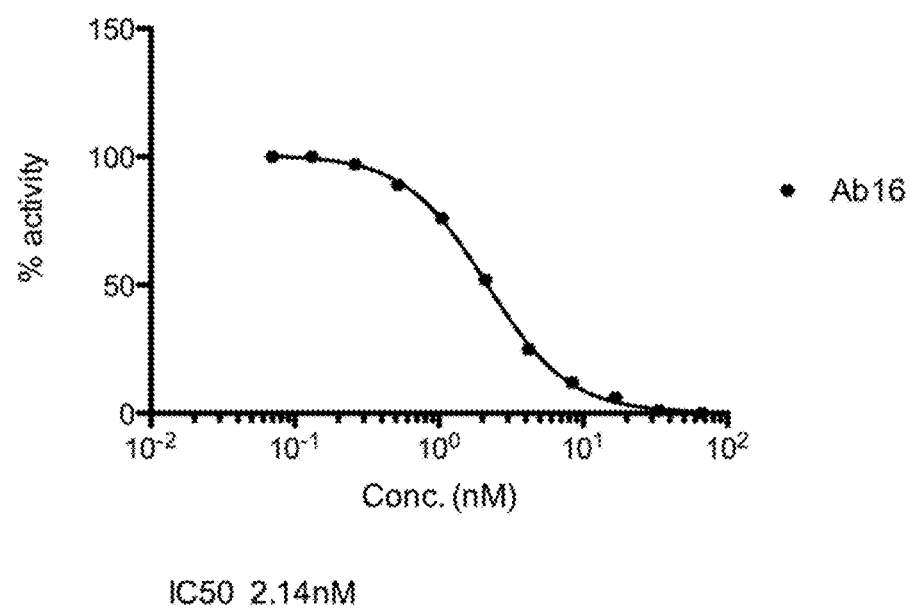
Figure 76. Inhibition of PCSK9 interaction with LDLR by antibody Ab16.

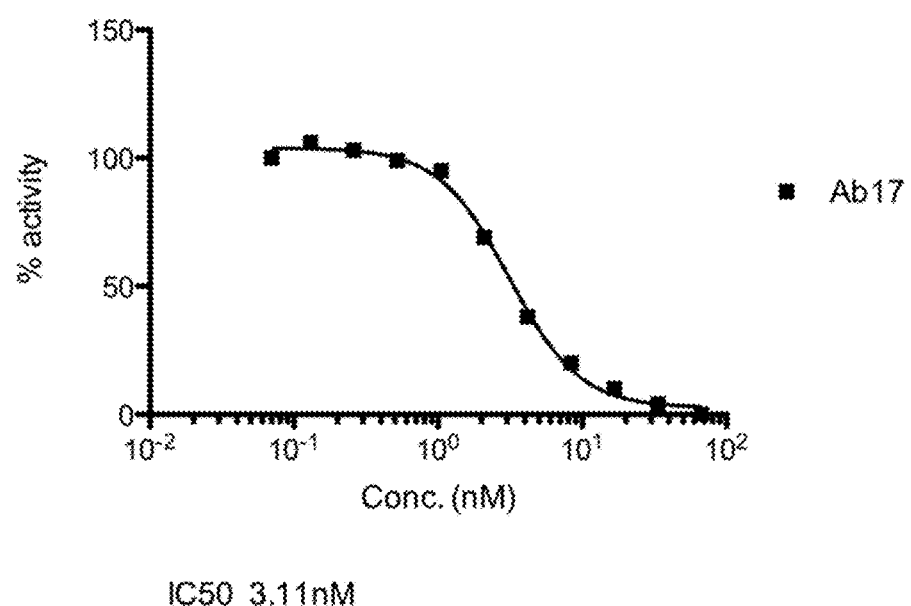
Figure 77. Inhibition of PCSK9 interaction with LDLR by antibody Ab17.

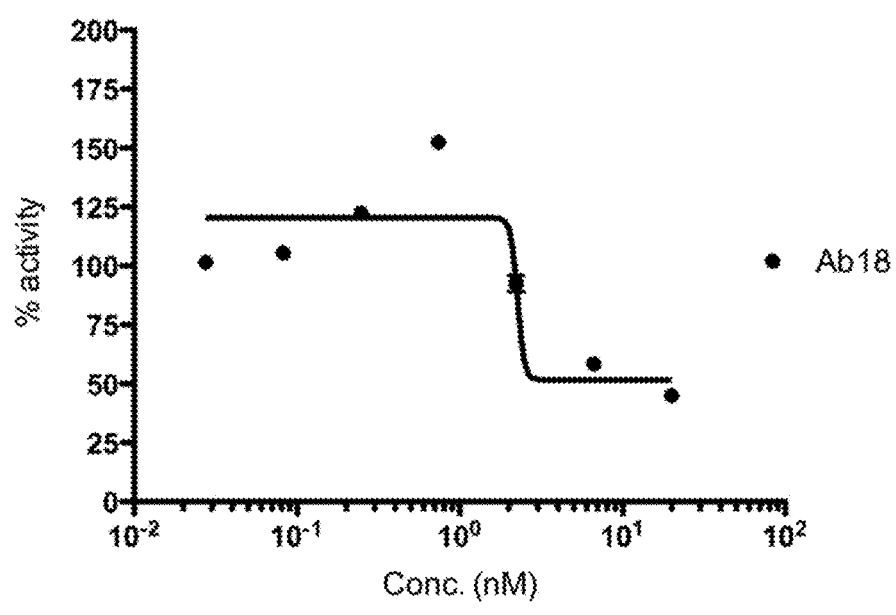
IC50 2.27nM
Figure 78. Inhibition of PCSK9 interaction with LDLR by antibody Ab18.

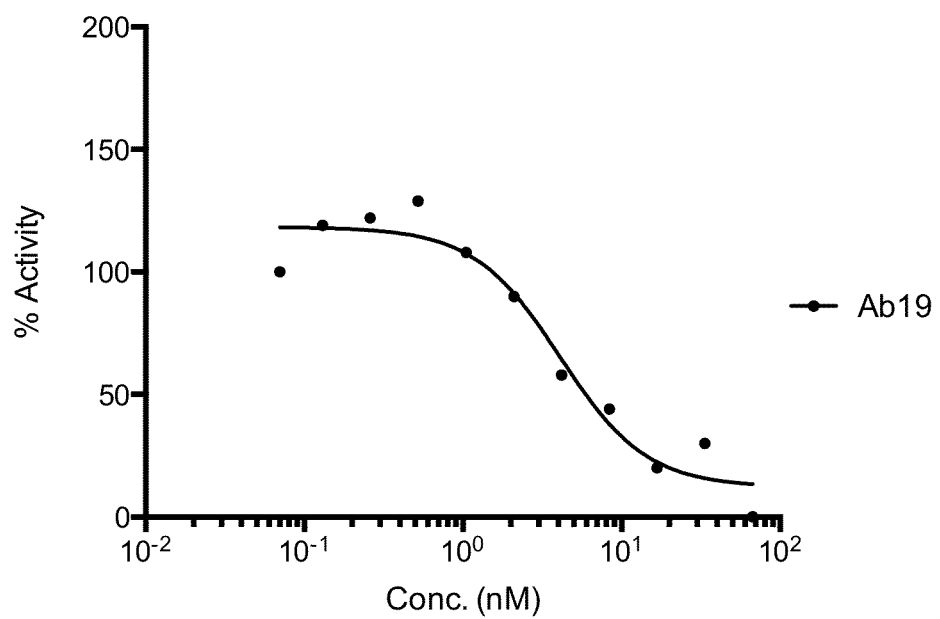
IC50 4.1nM
Figure 79. Inhibition of PCSK9 interaction with LDLR by antibody Ab19.

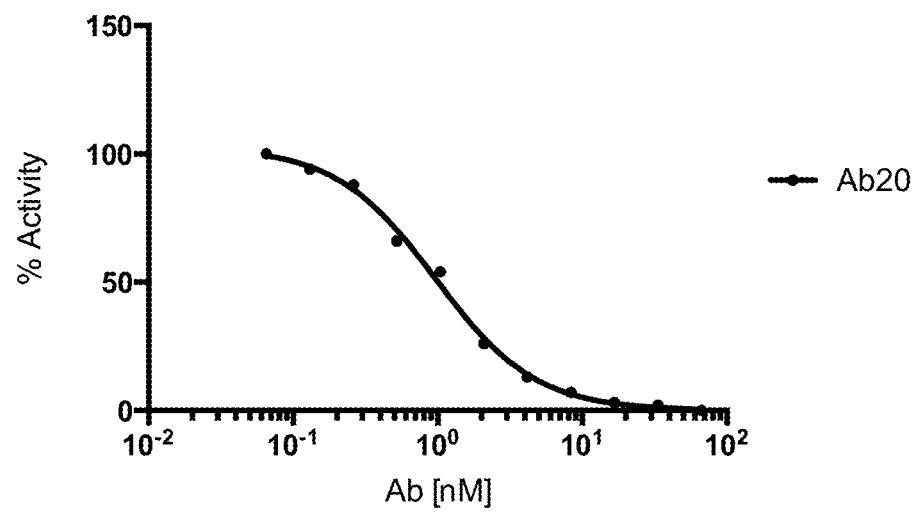
IC50 0.97nM
Figure 80. Inhibition of PCSK9 interaction with LDLR by antibody Ab20.

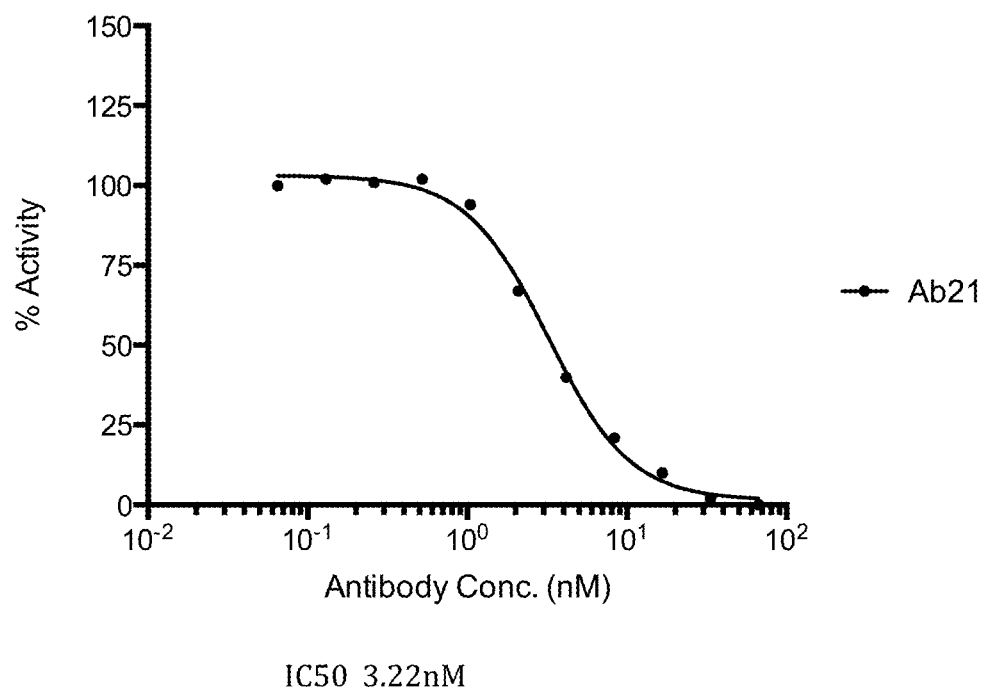
Figure 81. Inhibition of PCSK9 interaction with LDLR by antibody Ab21.

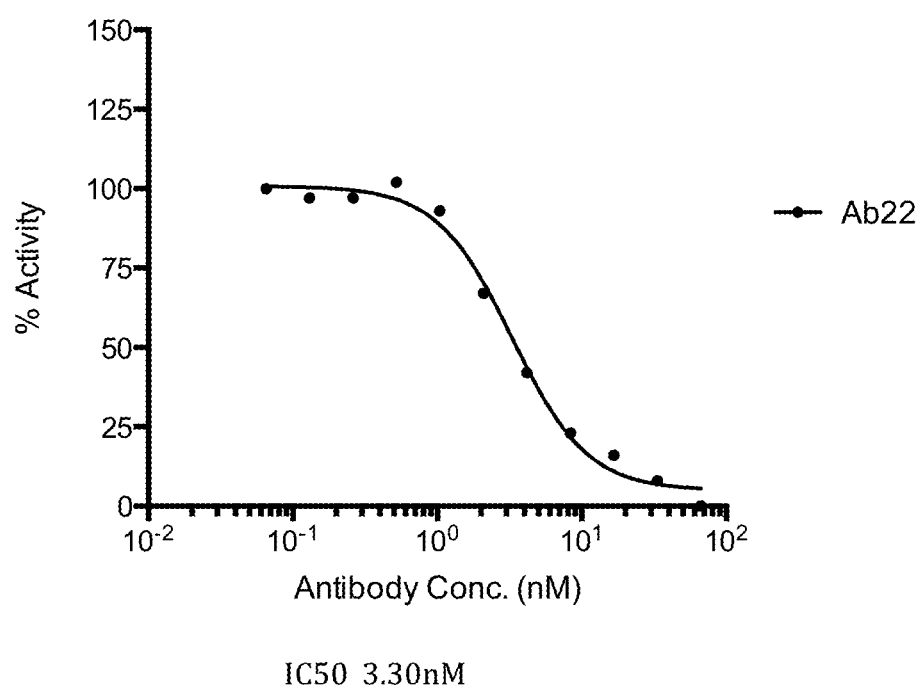
Figure 82. Inhibition of PCSK9 interaction with LDLR by antibody Ab22.

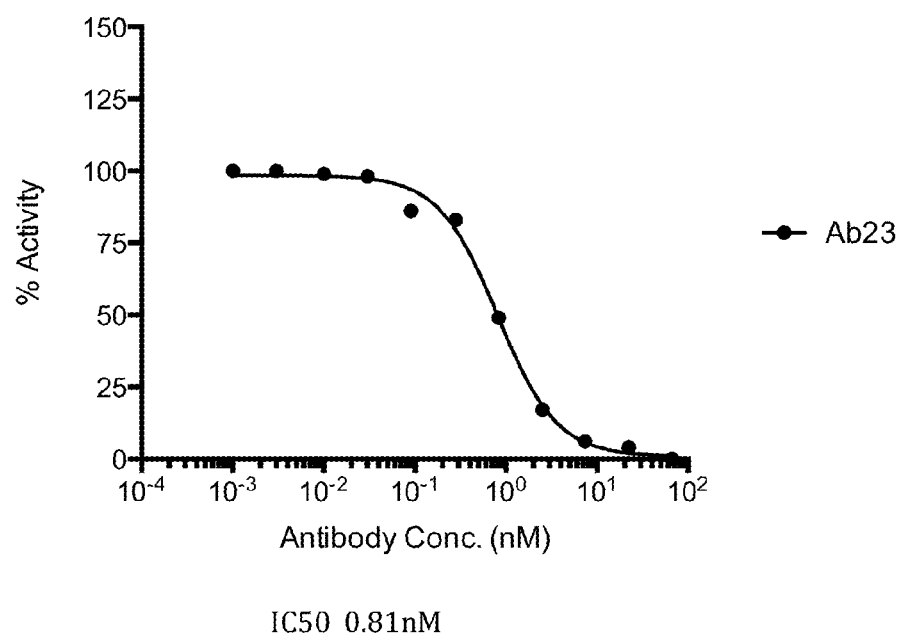
Figure 83. Inhibition of PCSK9 interaction with LDLR by antibody Ab23.

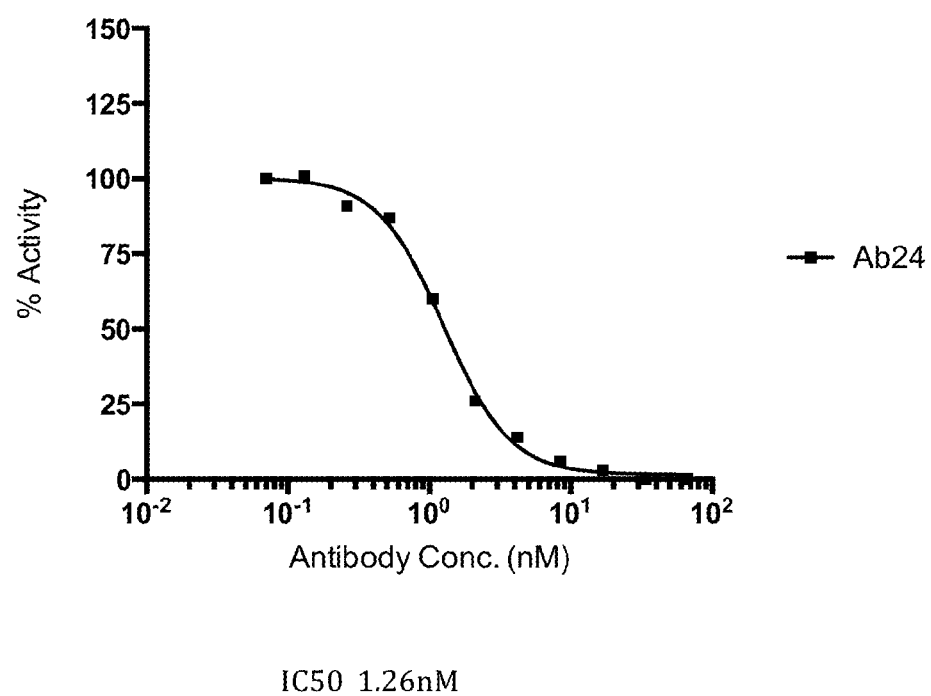
Figure 84. Inhibition of PCSK9 interaction with LDLR by antibody Ab24.

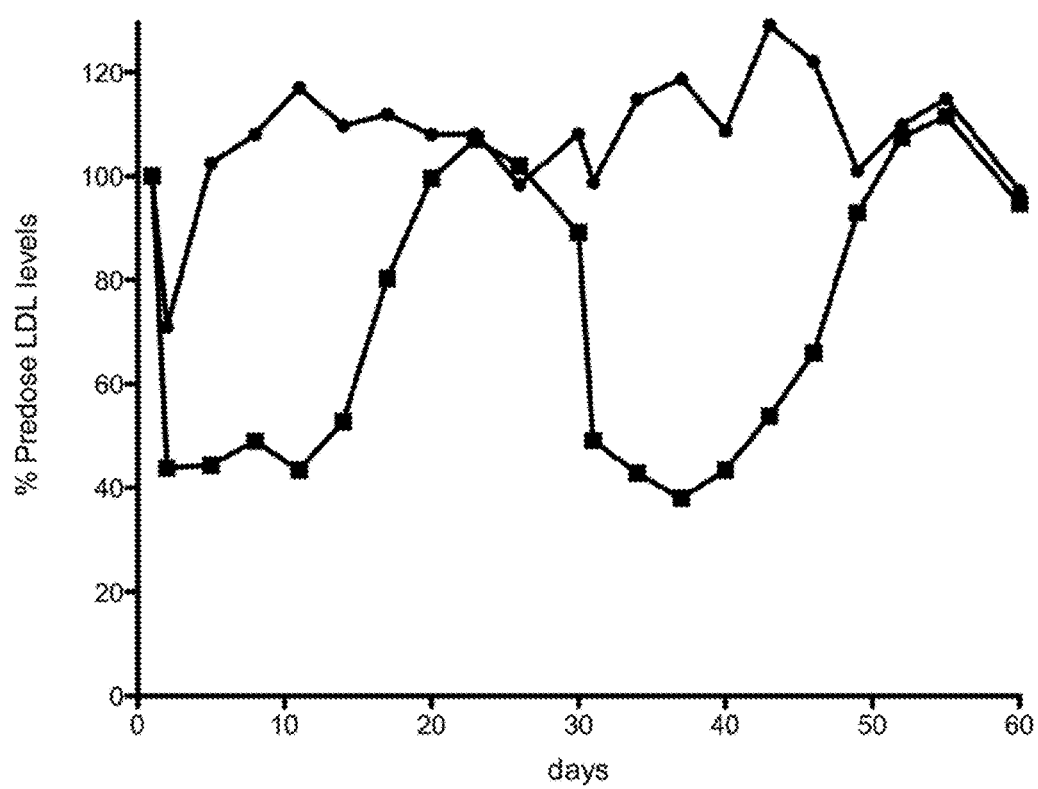
Figure 85. Serum LDL cholesterol level as a percentage change from pre-dose levels. Buffer control (●); Ab18 (■)

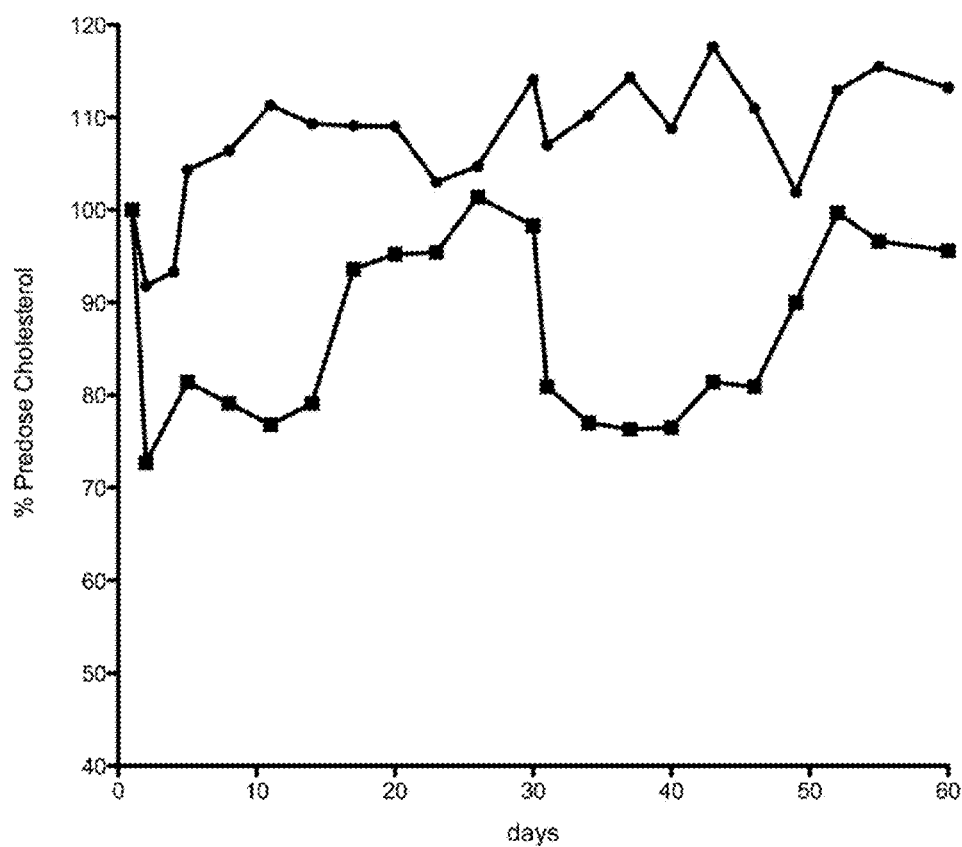
Figure 86. Serum total cholesterol level as a percentage change from pre-dose levels. Buffer control (●); Ab18 (■)

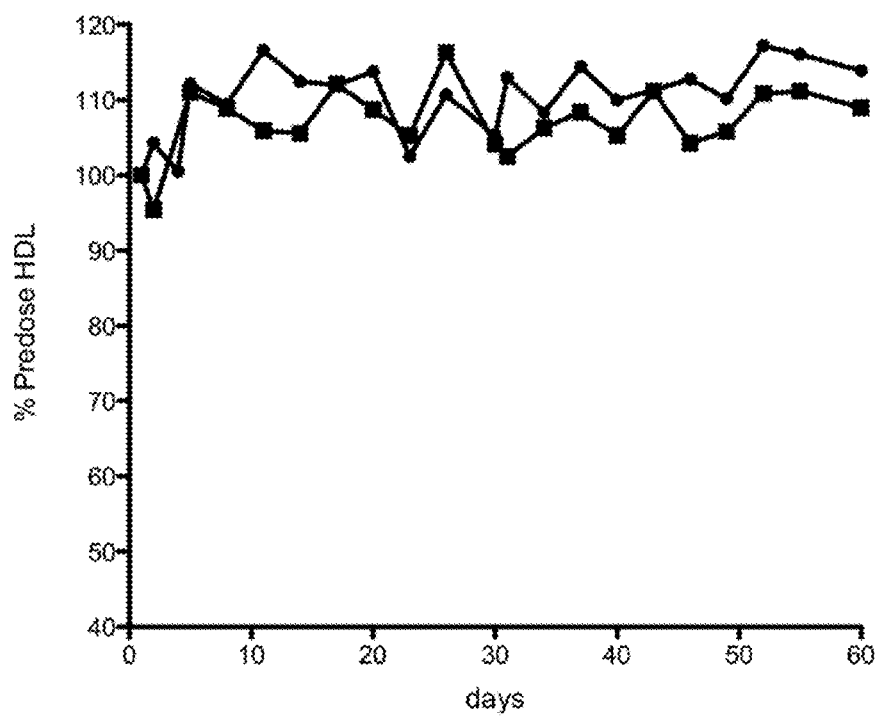
Figure 87. Serum HDL cholesterol level as a percentage change from pre-dose levels. Buffer control (●); Ab18 (■)

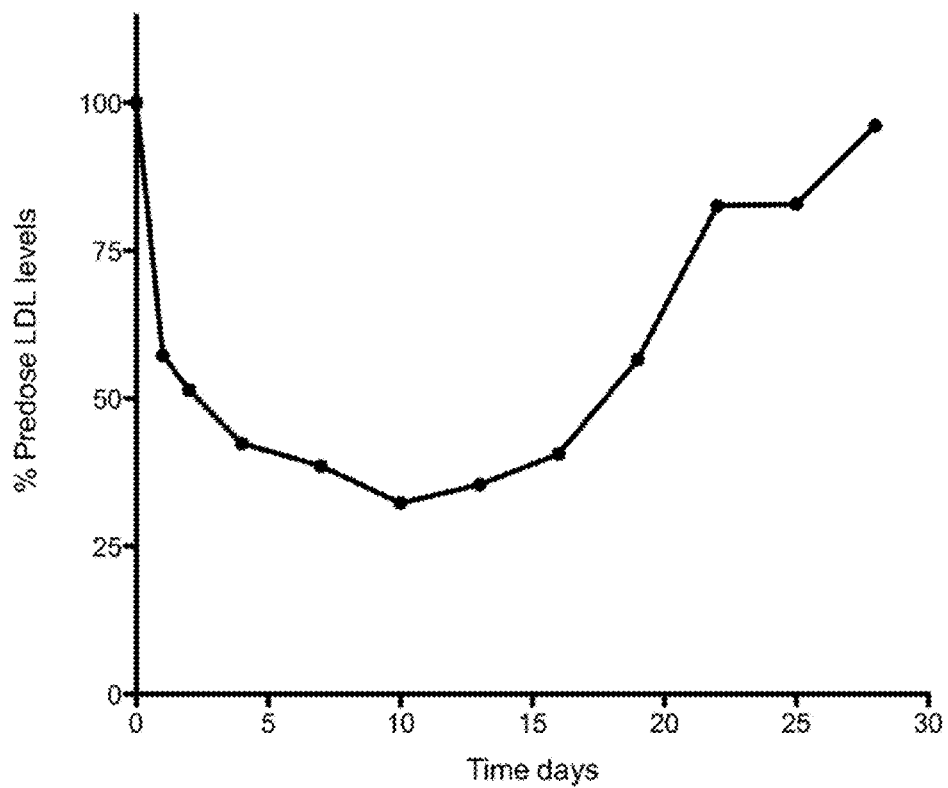
Figure 88. Serum LDL cholesterol level as a percentage change from pre-dose levels. Ab11 (●)

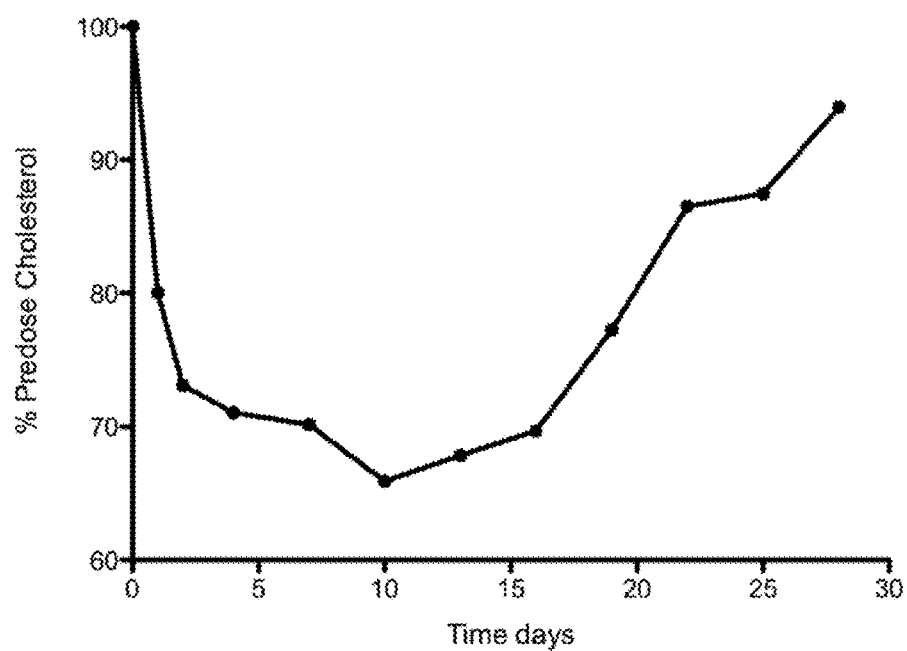
Figure 89. Serum total cholesterol level as a percentage change from pre-dose levels. Ab11 (●)

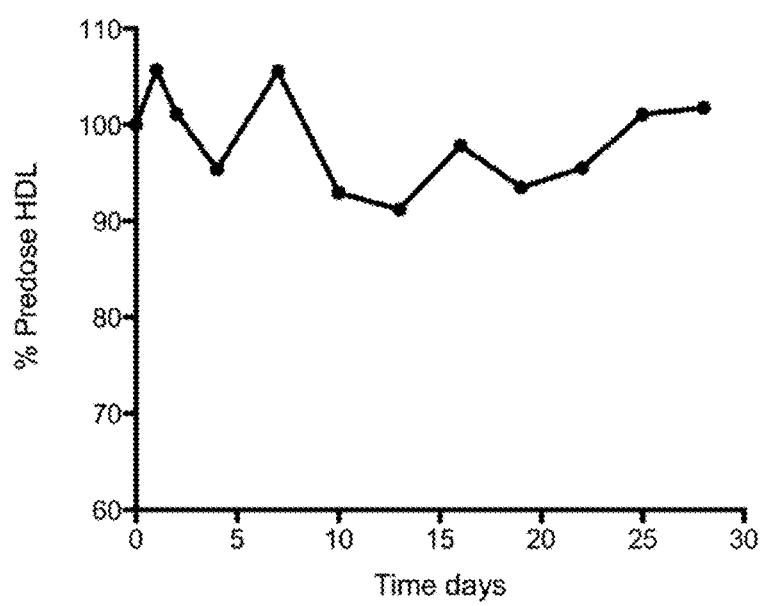
Figure 90. Serum HDL cholesterol level as a percentage change from pre-dose levels. Ab11 (●)

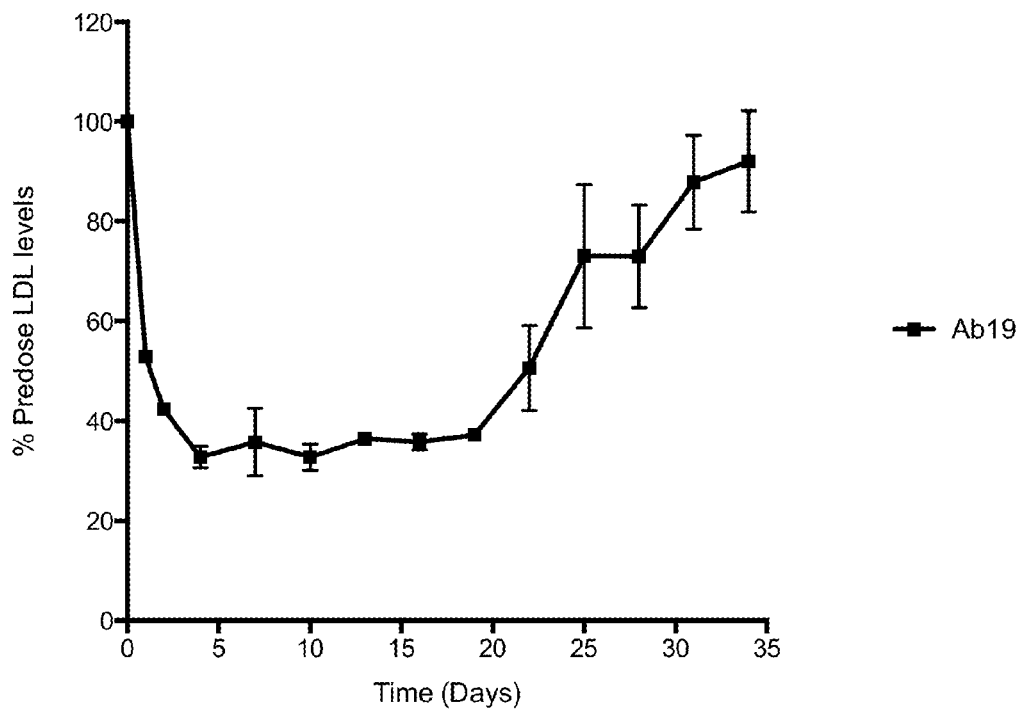
Figure 91. Serum LDL cholesterol level as a percentage change from pre-dose levels. Ab19.

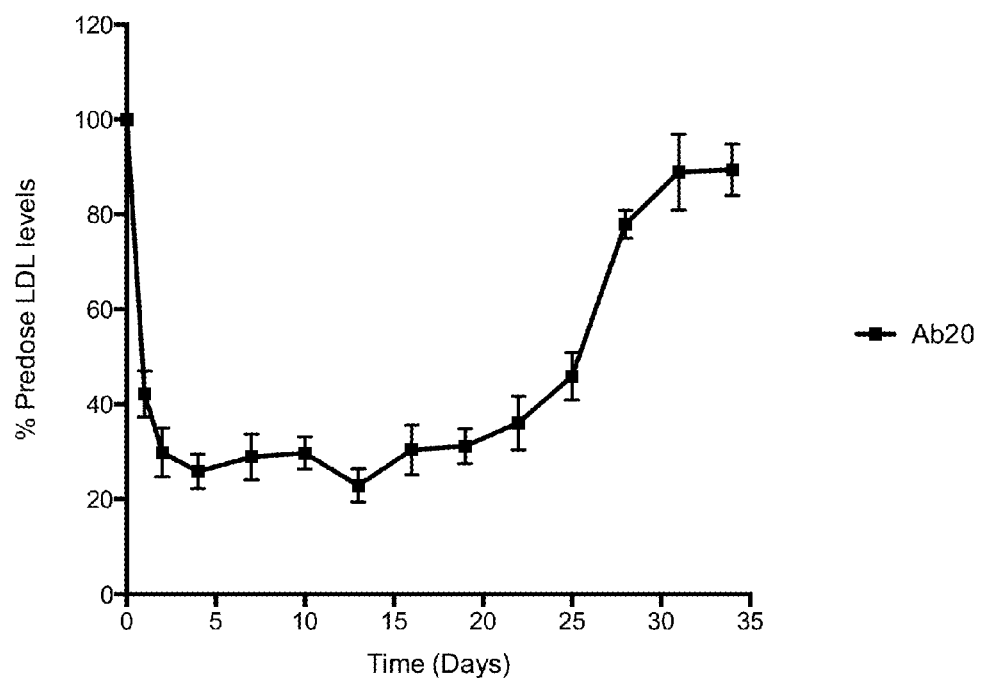
Figure 92. Serum LDL cholesterol level as a percentage change from pre-dose levels. Ab20.

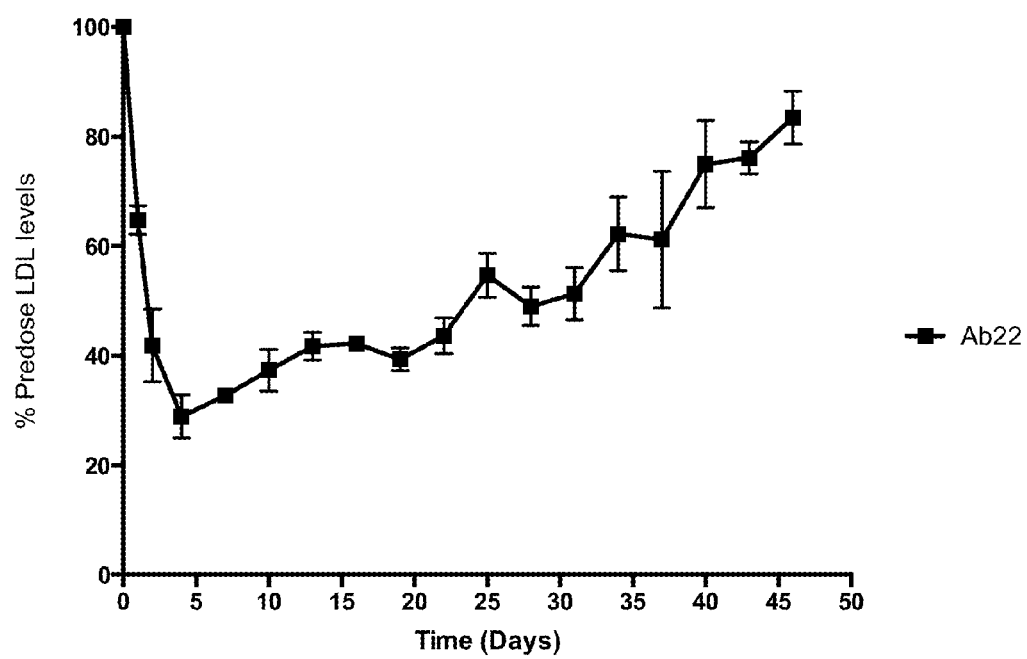
Figure 93. Serum LDL cholesterol level as a percentage change from pre-dose levels. Ab22.

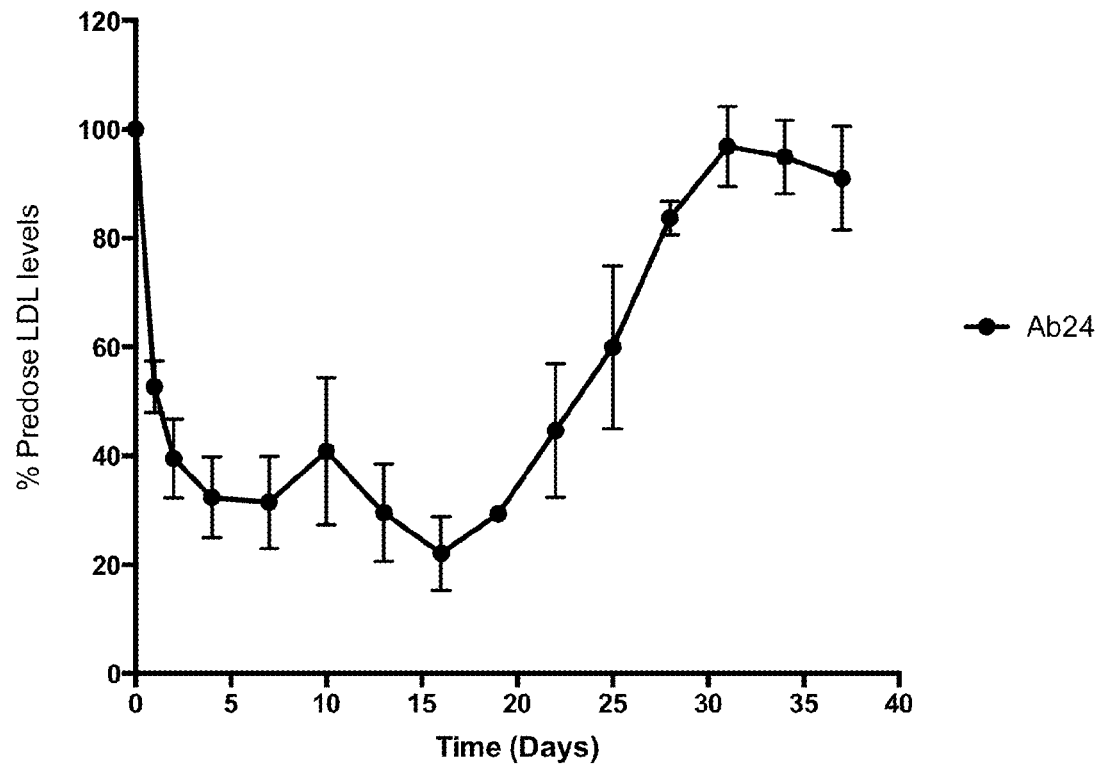
Figure 94. Serum LDL cholesterol level as a percentage change from pre-dose levels. Ab24

ANTI-PCSK9 ANTIBODIES AND USE THEREOF

RELATED APPLICATION DISCLOSURE

This application claims the benefit of U.S. Provisional Application Ser. No. 61/654,481, filed Jun. 1, 2012 and U.S. Provisional Application Ser. No. 61/644,065, filed May 8, 2012, each of which is hereby incorporated by reference in its entirety.

The instant application contains a Sequence Listing which has been submitted in ASCII format via EFS-Web and is hereby incorporated by reference in its entirety. Said ASCII copy, created on Mar. 10, 2013, is named 678580791000.txt and is 621,210 bytes in size.

BACKGROUND OF THE INVENTION

1. Field of the Invention

This invention pertains to novel antibodies and antibody fragments that specifically bind to human Proprotein Convertase Subtilisin-like/Kexin type 9 (hereinafter "PCSK9") and compositions containing. In addition the invention relates to nucleic acids encoding said antibodies and antibody fragments and the use thereof to express said antibodies and antibody fragments in desired host cells. Also, the invention relates to therapeutic and diagnostic use of these antibodies and antibody fragments.

More particularly, the invention provides rabbit antibodies and humanized and chimeric antibodies derived therefrom specific to PCSK9 as well as antibody fragments specific to PCSK9 which include e.g., Fab', F(ab')$_2$, Fv, scFv fragments, SMIPs (small molecule immunopharmaceuticals), camelbodies, nanobodies, monovalent antibodies such as MetMab like antibodies, and IgNAR.

Further, the invention provides nucleic acids and host cells containing that encode for and result in the expression of the subject anti-PCSK9 antibodies, i.e., rabbit antibodies and antibody fragments and modified forms thereof including by way of example humanized and chimeric antibodies derived therefrom as well as antibody fragments which include e.g., Fab', F(ab')$_2$, Fv, scFv fragments, SMIPs (small molecule immunopharmaceuticals), camelbodies, nanobodies, monovalent antibodies such as MetMab like antibodies, and IgNAR.

Also the invention relates to expression systems for the manufacture of the inventive anti-PCSK9 antibodies, including yeast, fungi, mammalian, and other cells useful for the manufacture of antibodies and antibody fragments.

Also, the invention relates to novel antibodies and antibody fragments that specifically bind to human PCSK9 which compete with and/or specifically bind to the same or overlapping epitope(s) on PCSK9 as any of the anti-PCSK9 antibodies and antibody fragments exemplified herein.

The invention further pertains to the in vivo use of the subject anti-PCSK9 antibodies and antibody fragments alone or in association with other active agents or drugs. for blocking, inhibiting or neutralizing PCSK9.

The invention further pertains to the in vivo use of the subject anti-PCSK9 antibodies and antibody fragments alone or in association with other active agents or drugs. for blocking or inhibiting the interaction of PCSK9 with LDLR.

The invention also specifically relates to methods for treating or preventing disorders of cholesterol or lipid homeostasis and disorders associated therewith including by way of example hypercholesterolemia, hyperlipidemia, hypertriglyceridaemia, sitosterolemia, atherosclerosis, arteriosclerosis, coronary heart disease, metabolic syndrome, acute coronary syndrome, xanthoma, hypertension, angina, obesity, diabetes and vascular inflammation, by the administration of the subject anti-PCSK9 antibodies and antibody fragments, wherein the subject antibodies and antibody fragments may be used alone or in association with other active agents.

The invention further specifically relates to methods of preventing or treating diseases and disorders associated with PCSK9, e.g., diseases associated with increased or decreased levels of PCSK9 and/or mutations in the PCSK9 gene that affect PCSK9 protein expression, primary sequence and/or function by administering said antibodies or fragments thereof alone or in combination with other active agents.

The present invention further provides methods for improving blood cholesterol markers associated with increased risk of heart disease using the subject antibodies and antibody fragments alone or in association with other active agents. These markers include, but are not limited to, high total cholesterol, high LDL, high total cholesterol to HDL ratio and high LDL-C to HDL ratio.

The present invention further provides methods for treating or preventing any of the following conditions or complications associated therewith such as hypercholesterolemia, heart disease, metabolic syndrome, diabetes, coronary heart disease, stroke, cardiovascular diseases, Alzheimer's disease and generally dyslipidemias, which can be manifested, for example, by an elevated total serum cholesterol, elevated LDL, elevated triglycerides, elevated VLDL, and/or low HDL. Some non-limiting examples of primary and secondary dyslipidemias that can be treated using an antibody or antibody fragment according to the invention, either alone, or in combination with one or more other agents include the metabolic syndrome, diabetes mellitus, familial combined hyperlipidemia, familial hypertriglyceridemia, familial hypercholesterolemias, including heterozygous hypercholesterolemia, homozygous hypercholesterolemia, familial defective apolipoprotein B-100; polygenic hypercholesterolemia; remnant removal disease, hepatic lipase deficiency; dyslipidemia secondary to any of the following: dietary indiscretion, hypothyroidism, drugs including estrogen and progestin therapy, beta-blockers, and thiazide diuretics; nephrotic syndrome, chronic renal failure, Cushing's syndrome, primary biliary cirrhosis, glycogen storage diseases, hepatoma, cholestasis, acromegaly, insulinoma, isolated growth hormone deficiency, and alcohol-induced hypertriglyceridemia.

In addition, antibody or antibody fragment according to the invention can also be useful in preventing or treating atherosclerotic diseases, such as, for example, coronary heart disease, coronary artery disease, peripheral arterial disease, stroke (ischaemic and hemorrhagic), angina pectoris, or cerebrovascular disease and acute coronary syndrome, myocardial infarction. In some embodiments, the antibody or antibody fragment according to the invention is useful in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries. In some embodiments, the antibody or antibody fragment according to the invention and methods can be used to reduce the risk of recurrent cardiovascular events.

The invention also particularly relates to the use of the subject anti-PCSK9 antibodies and antibody fragments in any of the aforementioned therapeutic indications or conditions in combination with other drugs that are typically used to treat such disorders, wherein the antibody and other drug or agent may be co-administered or separately administered. Non limiting examples of drugs that may be co-administered with the subject antibodies or antibody fragments or used in the same therapeutic regimen include by way of example statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol.

The invention further relates to compositions containing the subject anti-PCSK9 antibodies or antibody fragments, especially compositions are suitable for in vivo administration, e.g., subcutaneous, intravenous, intradermal, intranasal, rectal, vaginal, intrathecal, oral, and other administrable dosage forms.

The invention further relates to compositions containing the subject anti-PCSK9 antibodies or antibody fragments, especially compositions suitable for in vivo administration, e.g., subcutaneous, intravenous, intradermal, intranasal, rectal, vaginal, intrathecal, oral, and other administrable dosage forms which contain another active agent such as statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high or aberrant lipid or cholesterol levels.

The invention further relates to storage stable forms containing the subject anti-PCSK9 antibodies or antibody fragments, e.g., lyophilisates, suspensions, and buffered or temperature stable compositions.

The invention also pertains to methods of using the subject antibodies and antibody fragments that specifically bind to PCSK9 in screening assays to detect and monitor the levels of PCSK9 in serum samples, potentially for the diagnosis of diseases and disorders associated with PCSK9 or identifying individuals wherein the administration of the subject antibodies and antibody fragments that specifically bind to PCSK9 may have a therapeutic or prophylactic effect or for monitoring the effects of a treatment designed to modulate or neutralize PCSK9 or block cholesterol synthesis, e.g., a treatment involving administration of one of the subject anti-PCSK9 antibodies or antibody fragments.

2. Description of Related Art

Proprotein convertase subtilisin kexin type 9 (PCSK9) is a serine protease involved in regulating the levels of the low density lipoprotein receptor (LDLR) protein (Horton et al., 32(2) *Trends Biochem. Sci.* 71-77 (2007); Seidah and Prat, 85(7) *J. Mol. Med.* 685-96 2007). In vitro experiments have shown that adding PCSK9 to HepG2 cells lowers the levels of cell surface LDLR (Benjannet et al., 279 *J. Bio. Chem.* 48865-75 (2004); Lagace et al., 116(11) *J. Clin. Invest.* 2995-3005 (2006); Maxwell et al., 102(6) *Proc. Nat'l Acad. Sci.* 2069-74 (2005); Park et al., 279 *J. Biol. Chem.* 50630-38 (2004)). (While this protein is generally referred to as PCSK9, it is noted that this protein and corresponding gene has also been referred to in the patent and non-patent literature by other names including PSEC0052, FH3, HCHOLA3, LDLCQ1, NARC-1, NARC1, PC9).

Experiments with mice have shown that increasing PCSK9 protein levels decreases levels of LDLR protein in the liver (Benjannet et al., 279 *J. Bio. Chem.* 48865-75 (2004); Lagace et al., 116(11) *J. Clin. Invest.* 2995-3005 (2006); Maxwell et al., 102(6) *Proc. Nat'l Acad. Sci.* 2069-74 (2005); Park et al., 279 *J. Biol. Chem.* 50630-38 (2004)), while PCSK9 knockout mice have increased levels of LDLR in the liver (Rashid et al., 102(15) *Proc. Nat'l Acad. Sci.* 5374-79 (2005)). Additionally, various human PCSK9 mutations that result in either increased or decreased levels of plasma LDL-C have been identified (Kotowski et al., 78(3) *Am. J. Hum. Genet.* 410-22 (2006); Zhao et al., 79(3) *Am. J. Hum. Genet.* 514-23 (2006)). PCSK9 has been shown to directly interact with the LDLR protein, be endocytosed along with the LDLR, and co-immunofluoresce with the LDLR throughout the endosomal pathway (Lagace et al., 116(11) *J. Clin. Invest.* 2995-3005 (2006)). Several mutations in human PCSK9 cause gain-of-function effects in humans, including hypercholesterolemia, increased LDL-C cholesterol levels, and increased risk of coronary heart disease. (Garnier, 11(3) *Am. J. Cardiovasc. Drugs* 145-52 (2011)). Even rarer human PCSK9 mutations induce loss-of-function, resulting in lowered LDL-C levels and a 88% reduction in coronary heart disease risk. (Id.) PCSK9 interacts with the LDLR via the EGF domain and the complex is internalized. In the endosome, the lower pH results in an increased affinity between PCSK9 and LDLR and the complex is targeted for degradation in the lysosome (Horton et al., April Supp., *J. Lipid Res.* S172-177 (2009), *Sci.* 928-33 (2003)).

Several lines of evidence demonstrate that PCSK9, in particular, lowers the amount of hepatic LDLR protein and thus compromises the liver's ability to remove LDL cholesterol from the circulation. Adenovirus-mediated overexpression of PCSK9 in the livers of mice results in the accumulation of circulating LDL-C due to a dramatic loss of hepatic LDLR protein, with no effect on LDLR mRNA levels; Benjannet et al., 2004 J. Biol. Chem. 279:48865-48875; Maxwell & Breslow, 2004 PNAS 101:7100-7105; Park et al., 2004 J. Biol. Chem. 279:50630-50638; and Lalanne et al., 2005 J. Lipid Res. 46:1312-1319. The effect of PCSK9 overexpression on raising circulating LDL-C levels in mice is completely dependent on the expression of LDLR, again, indicating that the regulation of LDL-C by PCSK9 is mediated through downregulation of LDLR protein. In agreement with these findings, mice lacking PCSK9 or in which PCSK9 mRNA has been lowered by antisense oligonucleotide inhibitors have higher levels of hepatic LDLR protein and a greater ability to clear circulating LDL-C; Rashid et al., 2005 PNAS 102:5374-5379; and Graham et al., 2007 J. Lipid Res. 48(4): 763-767. In addition, lowering PCSK9 levels in cultured human hepatocytes by siRNA also results in higher LDLR protein levels and an increased ability to take up LDL-C; Benjannet et al., 2004 J. Biol. Chem. 279:48865-48875; and Lalanne et al., 2005 J Lipid Res. 46:1312-1319. Together, these data indicate that PCSK9 action leads to increased LDL-C by lowering LDLR protein levels.

A number of mutations in the gene PCSK9 have also been conclusively associated with autosomal dominant hypercholesterolemia ("ADH"), an inherited metabolism disorder characterized by marked elevations of low density lipoprotein ("LDL") particles in the plasma which can lead to premature cardiovascular failure; see Abifadel et al., 2003 Nature Genetics 34:154-156; Timms et al., 2004 Hum. Genet. 114:349-

353; Leren, 2004 Clin. Genet. 65:419-422. A later-published study on the S127R mutation of Abifadel et al., supra, reported that patients carrying such a mutation exhibited higher total cholesterol and apoB100 in the plasma attributed to (1) an overproduction of apoB100-containing lipoproteins, such as low density lipoprotein ("LDL"), very low density lipoprotein ("VLDL") and intermediate density lipoprotein ("IDL"), and (2) an associated reduction in clearance or conversion of said lipoproteins; Ouguerram et al., 2004 Arterioscler. Thromb. Vasc. Biol. 24:1448-1453.

PCSK9 is a prohormone-proprotein convertase in the subtilisin (S8) family of serine proteases (Seidah et al., 100(3) Proc. Nat'l Acad. Sci. 928-33 (2003)). Humans have nine prohormone-proprotein convertases that can be divided between the S8A and S8B subfamilies (Rawlings et al., 34 Nucleic Acids Research D270-72 (2006)). Furin, PC1/PC3, PC2, PACE4, PC4, PC5/PC6 and PC7/PC8/LPC/SPC7 are classified in subfamily S8B. Crystal and NMR structures of different domains from mouse furin and PC1 reveal subtilisin-like pro- and catalytic domains, and a P domain directly C-terminal to the catalytic domain (Henrich et al., 10(7) Nature Structural Bio. 520-26 (2005); Tangrea et al., 320(4) J. Mol. Bio. 801-12 (2002)). Based on the amino acid sequence similarity within this subfamily, all seven members are predicted to have similar structures (Henrich et al., 345(2) J. Mol. Bio. 211-27 (2005)). SKI-1/S1P and PCSK9 are classified in subfamily S8A. Sequence comparisons with these proteins also suggest the presence of subtilisin-like pro- and catalytic domains (Sakai et al., 2(4) Mol. Cell. 505-15 (1998); Seidah et al., 100(3) Proc. Nat'l Acad. Sci. 928-33 (2003); Seidah et al., 96(4) Proc. Nat'l Acad. Sci. 1321-26 (1999)). In these proteins, the amino acid sequence C-terminal to the catalytic domain is more variable and does not suggest the presence of a P domain.

Prohormone-proprotein convertases are expressed as zymogens, and they mature through a multi step process. The function of the pro-domain in this process is two-fold. The pro-domain first acts as a chaperone and is required for proper folding of the catalytic domain (Ikemura et al., 262 J. Biol. Chem. 7859-64 (1987)). Once the catalytic domain is folded, autocatalysis occurs between the pro-domain and catalytic domain. Following this initial cleavage reaction, the pro-domain remains bound to the catalytic domain where it then acts as an inhibitor of catalytic activity (Fu et al., 275 J. Biol. Chem. 16871-78 (2000)). When conditions are correct, maturation proceeds with a second autocatalytic event at a site within the pro-domain (Anderson et al., 16 Nature 1508-18 (1997)). After this second cleavage event occurs the pro-domain and catalytic domain dissociate, giving rise to an active protease.

Autocatalysis of the PCSK9 zymogen occurs between Gln152 and Ser153 (VFAQ|SIP) (Naureckiene et al., 420(1) Archives of Biochem. & Biophysics 55-67 (2003)), and has been shown to be required for its secretion from cells (Seidah et al., 100(3) Proc. Nat'l Acad. Sci. 928-33 (2003)). A second autocatalytic event at a site within PCSK9's pro-domain has not been observed. Purified PCSK9 is made up of two species that can be separated by non-reducing SDS-PAGE; the pro-domain at 17 Kd, and the catalytic plus C-terminal domains at 65 Kd. PCSK9 has not been isolated without its inhibitory pro-domain, and measurements of PCSK9's catalytic activity have been variable (Naureckiene et al., 420(1) Archives of Biochem. & Biophysics 55-67 (2003); Seidah et al., 100(3) Proc. Nat'l Acad. Sci. 928-33 (2003)).

Accordingly, there is substantial evidence indicating that PCSK9 plays a role in the regulation of LDL; that the expression or upregulation of PCSK9 is associated with increased plasma levels of LDL cholesterol, that the corresponding inhibition or lack of expression of PCSK9 is associated with reduced LDL cholesterol plasma levels; and that decreased levels of LDL cholesterol are associated with sequence variations in PCSK9 have been found to confer protection against coronary heart disease; Cohen, 2006 N. Engl. J. Med. 354: 1264-1272.

In clinical trials, reductions in LDL cholesterol levels have been directly related to the rate of coronary events; Law et al., 2003 BMJ 326:1423-1427. Also, moderate lifelong reduction in plasma LDL cholesterol levels was found to correlate with a substantial reduction in the incidence of coronary events; Cohen et al., supra. This was the case even in populations with a high prevalence of non-lipid-related cardiovascular risk factors; supra. Accordingly, there is great benefit to be reaped from the managed control of LDL cholesterol levels.

Based thereon, the identification of other molecules which may be used to modulate cholesterol levels and block or inhibit or neutralize the activity of PCSK9 would be of great interest. The present invention advances these interests by providing novel antagonists of PCSK9 for use for in blocking, inhibiting or neutralizing one or more of the activities of PCSK9 and/or in blocking the interaction of PCSK9 with LDLR and/or for the treatment of therapeutic conditions identified herein especially those involving or associated with high or aberrant lipid or cholesterol levels.

BRIEF SUMMARY OF THE INVENTION

The present invention provides novel antibodies and antibody fragments that specifically bind PCSK9, as well as antibodies that compete with such antibodies or antibody fragments, or which specifically bind to the same or overlapping epitope, or antibodies which contain any or all of the CDRs of the novel antibodies and antibody fragments exemplified herein. These antibodies and antibody fragments may be used to block, inhibit or neutralize the in vivo effects of serum PCSK9 in vivo, and in some embodiments specifically inhibit or block the PCSK9/LDLR binding interaction and thereby inhibit or neutralize one or all of the biological effects associated with this binding interaction.

Particularly, the invention provides novel antibodies and antibody fragments that specifically bind to human PCSK9 and compositions containing. More particularly, the invention provides rabbit anti-PCSK9 antibodies and antibody fragments as well as humanized and chimeric antibodies and antibody fragments derived therefrom such as Fab, Fab', F(ab')$_2$, Fv, scFv fragments, SMIPs (small molecule immunopharmaceuticals), camelbodies, nanobodies, monovalent antibodies such as MetMab like antibodies, and IgNAR.

The invention further describes the use of the subject anti-PCSK9 antibodies and antibody fragments for treating any subject wherein blocking, inhibiting or neutralizing the in vivo effect of PCSK9 or blocking or inhibiting the interaction of PCSK9 and LDLR is therapeutically desirable, wherein the subject anti-PCSK9 antibodies or antibody fragments may be used alone or in association with other active agents or drugs.

The invention also describes methods for treating or preventing disorders of cholesterol or lipid homeostasis and disorders which may be associated therewith including by way of example hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, diabetes, obesity, angina, hypertension and xanthoma by the administration of the subject anti-PCSK9 antibodies and antibody fragments that specifically bind to PCSK9, wherein the subject antibodies and antibody fragments may be used alone or in association with other active agents.

The invention further provides methods of preventing or treating diseases and disorders associated with PCSK9, e.g., diseases associated with increased or decreased levels of PCSK9 and/or mutations in the PCSK9 gene that affect PCSK9 protein expression, primary sequence and/or function by administering said antibodies or fragments thereof alone or in combination with other active agents.

The invention broadly encompasses the use of the subject anti-PCSK9 antibodies and fragments in treating any subject having a condition or at risk of developing a condition wherein modulation of lipid or cholesterol levels is clinically desirable or where the subject has a condition that is often associated with high lipids or cholesterol.

Also specifically the present invention provides methods for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma, hypertension, angina and related conditions by administration of the subject anti-PCSK9 antibodies and antibody fragments alone or in association with other active agents.

The present invention further provides methods for improving blood cholesterol markers associated with increased risk of heart disease using the subject antibodies and antibody fragments alone or in association with other active agents. These markers include, but are not limited to, high total cholesterol, high LDL, high total cholesterol to HDL ratio and high LDL-C to HDL ratio.

The invention also particularly relates to the use of the subject anti-PCSK9 antibodies and antibody fragments in any of the aforementioned therapeutic indications or conditions in combination with other drugs that are typically used to treat such disorders, wherein the antibody and other drug or agent may be co-administered or separately administered. Examples of drugs include that may be co-administered with the subject anti-PCSK9 antibodies or antibody fragments or in the same therapeutic regimen include by way of example statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol or aberrant lipid levels or lipid metabolism.

The invention further relates to compositions containing the subject anti-PCSK9 antibodies or antibody fragments, especially compositions are suitable for in vivo administration, e.g., subcutaneous, intravenous, intradermal, intranasal, intrathecal, vaginal, rectal, and other injectable or topical administrable dosage forms.

The present invention further provides methods for treating or preventing any of the following conditions or complications associated therewith such as hypercholesterolemia, heart disease, metabolic syndrome, diabetes, coronary heart disease, stroke, cardiovascular diseases, Alzheimer's disease and generally dyslipidemias, which can be manifested, for example, by an elevated total serum cholesterol, elevated LDL, elevated triglycerides, elevated VLDL, and/or low HDL. Some non-limiting examples of primary and secondary dyslipidemias that can be treated using an antibody or antibody fragment according to the invention, either alone, or in combination with one or more other agents include the metabolic syndrome, diabetes mellitus, familial combined hyperlipidemia, familial hypertriglyceridemia, familial hypercholesterolemias, including heterozygous hypercholesterolemia, homozygous hypercholesterolemia, familial defective apolipoprotein B-100; polygenic hypercholesterolemia; remnant removal disease, hepatic lipase deficiency; dyslipidemia secondary to any of the following: dietary indiscretion, hypothyroidism, drugs including estrogen and progestin therapy, beta-blockers, and thiazide diuretics; nephrotic syndrome, chronic renal failure, Cushing's syndrome, primary biliary cirrhosis, glycogen storage diseases, hepatoma, cholestasis, acromegaly, insulinoma, isolated growth hormone deficiency, and alcohol-induced hypertriglyceridemia.

In addition, the present invention further provides methods for use of the subject anti-PCSK9 antibody or antibody fragment in preventing or treating atherosclerotic diseases, such as, for example, coronary heart disease, coronary artery disease, peripheral arterial disease, stroke (ischaemic and hemorrhagic), angina pectoris, or cerebrovascular disease and acute coronary syndrome, myocardial infarction; in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries; and to reduce the risk of recurrent cardiovascular events.

More specifically, the invention provides compositions containing at least one of the subject anti-PCSK9 antibodies or antibody fragments, especially compositions which are suitable for in vivo administration, e.g., subcutaneous, intravenous, intradermal, intranasal, intrathecal, vaginal, rectal, oral and other injectable or topical dosage forms which optionally may contain another active agent such as statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol. The invention also provides novel dosage regimens using the subject anti-PCSK9 antibodies or antibody fragments, alone or in association with another active agent, especially subcutaneous, oral and intravenous dosing regimens.

The invention further relates to storage stable forms containing the subject anti-PCSK9 antibodies or antibody fragments, e.g., lyophilisates, suspensions, and buffered or temperature stable compositions containing.

The invention also provides methods of using the subject antibodies and antibody fragments that specifically bind to PCSK9 in screening assays to detect and monitor the levels of PCSK9 in serum samples, potentially for the diagnosis of diseases and disorders associated with PCSK9 or in identifying individuals wherein the administration of the subject antibodies and antibody fragments that specifically bind to PCSK9 may have a therapeutic or prophylactic effect or for monitoring the effects of a treatment designed to modulate or neutralize PCSK9 or block cholesterol synthesis, e.g., a treatment involving administration of one of the subject or other anti-PCSK9 antibodies or antibody fragments.

Further, the invention provides specific anti-PCSK9 antibodies and fragments thereof and diagnostic or pharmaceutical compositions containing having particular epitopic specificity for PCSK9, and preferably antibodies or fragments thereof having high affinity or avidity and/or other desired functional properties.

In addition, the invention relates to any therapeutic or diagnostic use of the antibodies described herein, or antibodies competing therewith or possessing the same or overlapping epitopic specificity, preferably antibodies or antibody fragments comprising one or all of the CDRs of one of the exemplified anti-PCSK9 antibodies or antibody fragments, or more preferably an antibody comprising one or more variable or CDR sequences which possess at least 80, 90, or 95, 96, 97, 98, 99 or 100% identity to any of the VH, VL and CDR polypeptides described herein, and to polynucleotides encoding these antibodies and antibody fragments and host cells containing. A preferred embodiment of the invention is directed to chimeric or humanized antibodies and fragments thereof (such as Fab or Fv or monovalent fragments) capable of binding to PCSK9, and preferably which inhibit, block or neutralize the biological activities of PCSK9 or which block or inhibit the binding of PCSK9 to LDLR.

In some aspects, the invention comprises an isolated antibody or antibody fragment that competes for binding to PCSK9 or binds with the same or an overlapping epitope on PCSK9 as an antibody or antibody fragment according to the invention.

In some aspects, the invention comprises a method for treating or preventing a condition associated with elevated serum cholesterol levels in a patient, comprising administering to a patient in need thereof an effective amount of at least one anti-PCSK9 antibody or antibody fragment according to the invention.

In some aspects, the invention comprises a method of inhibiting binding of PCSK9 to LDLR in a subject in need thereof comprising administering an effective amount of at least one anti-PCSK9 antibody or antibody fragment according to the invention.

In some aspects, the invention comprises an anti-PCSK9 antibody or antibody fragment according to the invention that binds to PCSK9 with a KD that is less than 100 nM.

In some aspects, the invention comprises a method for treating or preventing a condition associated with elevated serum cholesterol levels in a subject, the method comprising administering to a subject in need thereof an effective amount of at least one anti-PCSK9 antibody or antibody fragment according to the invention simultaneously or sequentially with another active agent, e.g., one that reduces cholesterol levels or which elevates the availability of LDLR protein.

In some aspects, the invention comprises a method of lowering serum cholesterol levels in a subject, the method comprising administering to a subject an effective amount of at least at least one anti-PCSK9 antibody or antibody fragment according to the invention.

In some aspects, the invention comprises a method of lowering serum cholesterol level in a subject, the method comprising administering to a subject an effective amount of at least one anti-PCSK9 antibody or antibody fragment according to the invention, simultaneously or sequentially with another agent that elevates the availability of LDLR protein or which reduces serum cholesterol.

In some aspects, the invention comprises a method of increasing LDLR protein level in a subject, the method comprising administering to a subject an effective amount of at least one anti-PCSK9 antibody or antibody fragment according to the invention.

In some aspects, the invention comprises a method of increasing LDLR protein levels in a subject, the method comprising administering to a subject an effective amount of at least one at least one anti-PCSK9 antibody or antibody fragment according to the invention simultaneously or sequentially with an agent that elevates the availability of LDLR protein or one which reduces serum cholesterol.

In some aspects, the invention further provides methods of preventing or treating diseases and disorders associated with PCSK9, e.g., diseases associated with increased or decreased levels of PCSK9 and/or mutations in the PCSK9 gene that affect PCSK9 protein expression, primary sequence and/or function by administering at least one at least one anti-PCSK9 antibody or antibody fragment according to the invention in combination with other agents.

In other aspects the present invention provides methods for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma and related conditions using the subject anti-PCSK9 antibodies and antibody fragments.

In other specific aspects the present invention provides methods for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma and other conditions such as obesity, hypertension, diabetes, wherein the subject is treated with the subject anti-PCSK9 antibodies and antibody fragments, in combination with other drugs used to treat such disorders such as e.g., statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol.

ACE inhibitors may be used in combination with the subject anti-PCSK9 antibodies and antibody fragments wherein the moieties may be jointly or separately administered by the same or different means of administration include by way of example: Capoten (captopril), Vasotec (enalapril), Prinivil, Zestril (lisinopril), Lotensin (benazepril), Monopril (fosinopril), Altace (ramipril), Accupril (quinapril), Aceon (perindopril), Mavik (trandolapril), Univasc (moexipril), ARBs may be used in combination with the subject anti-PCSK9 antibodies and antibody fragments wherein the moieties may be jointly or separately administered by the same or different means of administration include by way of example: Cozaar (losartan), Diovan (valsartan), Avapro (irbesartan), Atacand (candesartan), and Micardis (telmisartan).

Antiarrhythmics may be used in combination with the subject anti-PCSK9 antibodies and antibody fragments include by way of example: Tambocor (flecamide), Procanbid (procainamide), Cordarone (amiodarone), and Betapace (sotalol).

Anticlotting agents which may be used in combination with the subject anti-PCSK9 antibodies and antibody fragments wherein the moieties may be jointly or separately administered by the same or different means of administration include: Tissue plasminogen activator (TPA), Tenecteplase, Alteplase, Urokinase, Reteplase, and Streptokinase.

Beta-blockers may be used in combination with the subject anti-PCSK9 antibodies and antibody fragments wherein the moities may be jointly or separately administered by the same or different means of administration include by way of example: Sectral (acebutolol), Zebeta (bisoprolol), Brevibloc (esmolol), Inderal (propranolol), Tenormin (atenolol), Normodyne, Trandate (labetalol), Coreg (carvedilol), Lopressor, and Toprol-XL (metoprolol).

Calcium channel blockers which may be used in combination with the subject anti-PCSK9 antibodies and antibody fragments wherein the moieties may be jointly or separately administered by the same or different means of administration include by way of example: Norvasc (amlodipine), Plendil (felodipine), Cardizem, Cardizem CD, Cardizem SR, Dilacor XR, Diltia XT, Tiazac (diltiazem), Calan, Calan SR, Covera-HS, Isoptin, Isoptin SR, Verelan, Verelan PM (verapamil), Adalat, Adalat CC, Procardia, Procardia XL (nifedipine), Cardene, Cardene SR (nicardipine), Sular (nisoldipine), Vascor (bepridil), and Caduet which is a combination of a statin cholesterol drug and amlodipine.

Diuretics which may be used in combination with the subject anti-PCSK9 antibodies and antibody fragments wherein the moieties may be jointly or separately administered by the same or different means of administration include by way of example Lasix (furosemide), Bumex (bumetanide), Demadex (torsemide), Esidrix (hydrochlorothiazide), Zaroxolyn (metolazone), and Aldactone (spironolactone).

Heart failure drugs which may be used in combination with the subject anti-PCSK9 antibodies and antibody fragments wherein the moieties may be jointly or separately administered by the same or different means of administration include by way of example Dobutrex (dobutamine), and Primacor (milrinone).

Vasodilators which may be used in combination with the subject anti-PCSK9 antibodies and antibody fragments wherein the moieties may be jointly or separately administered by the same or different means of administration include by way of example Dilatrate-SR, Iso-Bid, Isonate, Isorbid, Isordil, Isotrate, Sorbitrate (isosorbide dinitrate), IMDUR (isorbide mononitrate), and BiDil (hydralazine with isosorbide dinitrate.

Blood thinners which may be used in combination with the subject anti-PCSK9 antibodies and antibody fragments wherein the moieties may be jointly or separately administered by the same or different means of administration include by way of example Warfarin (coumadin), Heparin, Lovenox, and Fragmin.

In other aspects the present invention further provides methods for improving blood cholesterol markers associated with increased risk of heart disease using the subject antibodies and antibody fragments in association with any of the foregoing or other actives wherein the moieties may be jointly or separately administered by the same or different means of administration. These markers include, but are not limited to, high total cholesterol, high LDL-C, high total cholesterol to HDL ratio and high LDL-C to HDL ratio.

In some aspects, the invention comprises a pharmaceutical composition comprising an antibody protein or fragment according to the invention and another active, e.g., one of the actives above-identified, e.g., an agent that elevates the availability of LDLR protein levels or an agent which blocks or inhibits cholesterol synthesis. In some embodiments, the agent that blocks cholesterol synthesis comprises a statin. The statin in some instances potentially may further elevate LDLR levels. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is further combined with niacin, an absorption inhibitor (ezetimibe), a lipid modifying agent, or a combination thereof. In some embodiments, the agent that elevates the availability of LDLR protein levels comprises a cytokine such as oncostatin M, or a hormone like estrogen, and/or a herbal moiety such as berberine.

In some aspects, the invention comprises a pharmaceutical composition comprising an antibody protein or fragment or variant thereof according to the invention and an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a pharmaceutical composition comprising an antibody protein or fragment according to the invention and a bile acid sequestering agent. In some embodiments, the bile sequestering agent is selected from the group consisting of cholestyramine, colesevelam, colestipol, and some combination thereof.

In some aspects, the invention comprises a pharmaceutical composition comprising an antibody or antibody fragment according to the invention and an agent that decreases cholesterol absorption in the intestine. In some embodiments, the agent that decreases cholesterol absorption in the intestine is ezetimibe.

In some aspects, the invention comprises a pharmaceutical composition comprising an antibody or fragment according to the invention and an agent that decreases cholesterol levels. In some embodiments, the agent that decreases cholesterol levels is selected from the group consisting of certain antipsychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a pharmaceutical composition comprising an antibody or fragment according to the invention and a PPAR gamma agonist, PPAR alpha/gamma agonist, squalene synthase inhibitor, CETP inhibitor, anti-hypertensive, anti-diabetic agent (such as sulphonyl ureas, insulin, GLP-1 analogs, DDPIV inhibitors), ApoB modulator, MTP inhibitors, arteriosclerosis obliterans treatments, or a combination thereof.

In some aspects, the invention comprises a pharmaceutical composition comprising an antibody or fragment according to the invention and an agent that increases HDL levels. In some embodiments, the agent that increases HDL levels is niacin, also known as nicotinic acid. In some embodiments, the niacin is a slow-release formulation.

In some aspects, the invention comprises a pharmaceutical composition comprising an antibody or fragment according to the invention and an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a pharmaceutical composition comprising an antibody or fragment according to the invention and an agent that decreases lipid absorption in the intestine. In some embodiments, the agent that decreases lipid absorption in the intestine is selected from the group consisting of orlistat, lipstatin, and some combination thereof.

In some aspects, the invention comprises a pharmaceutical composition comprising an antibody or fragment according to the invention and an agent that is an anti-hypertensive and/or treats angina. In some embodiments, the agent that is an anti-hypertensive and/or treats angina is amlodipine.

In some aspects, the invention comprises a pharmaceutical composition comprising an antibody or fragment according to the invention and at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention or fragment or variant thereof and at least one other agent are not administered simultaneously, with the antibody or antibody fragment according to the invention being administered before or after the at least one other agent is administered.

In some aspects, the invention comprises a pharmaceutical composition comprising an antibody or fragment according to the invention and at least one other agent for treating a condition associated with aberrant cholesterol or for treating a condition wherein the individuals often have high cholesterol. For example, an antibody protein or fragment or variant thereof according to the invention may be combined or co-administered with other drugs such as ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, or other drugs used to treat conditions wherein the treated individual may have high cholesterol. Examples of such drugs are identified supra. In some embodiments, the antibody or fragment according to the invention and at least one other agent are not administered simultaneously, with the antibody or antibody fragment according to the invention being administered before or after the at least one other agent is administered.

In some aspects, the invention comprises a method for treating or preventing a condition associated with elevated serum cholesterol level in a patient comprising administering to a patient in need thereof an effective amount of at least one isolated antibody or antibody fragment according to the invention as disclosed herein. In some embodiments, the condition is hypercholesterolemia.

In some aspects, anti-PCSK9 antibodies or fragments according to the invention bind to PCSK9 with a KD that is less than about 100 nM. In some embodiments, the anti-PCSK9 antibodies or fragments according to the invention bind PCSK9 with a KD that is between about 10 and about 100 nM. In some embodiments, the anti-PCSK9 antibodies or fragments according to the invention bind PCSK9 with a KD that is less than about 10 nM. In some embodiments, the antibody or fragment that binds PCSK9 has a KD that is between about 1 and about 10 nM. In some embodiments, the anti-PCSK9 antibodies or fragments according to the invention that binds PCSK9 has a KD that is less than about 1 nM. In some embodiments, the anti-PCSK9 antibodies or fragments according to the invention has a KD that is between about 0.1 and about 1 nM. In some embodiments, the anti-PCSK9 antibodies or fragments according to the invention that binds PCSK9 has a KD that is between about 0.1 and about 0.5 nM. In some embodiments, the anti-PCSK9 antibodies or fragments according to the invention binds PCSK9 with a KD that is between about 0.01 and about 0.1 nM. In some embodiments, the anti-PCSK9 antibodies or fragments according to the invention binds PCSK9 with a KD that is between about 0.1 and about 10 nM. In some embodiments, the anti-PCSK9 antibodies or fragments according to the invention bind PCSK9 with a KD that is between 0.120 and about 7.99 nM.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases cholesterol and which optionally further elevates the availability of LDLR protein. In some embodiments, the agent that reduces cholesterol and which optionally elevates the availability of LDLR protein comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with a bile acid sequestering agent. In some embodiments, the bile acid sequestering agent is selected from the group consisting of cholestyramine, colesevelam, colestipol, and some combination thereof.

In some aspects, the invention comprises a method for treating or preventing a condition associated with elevated serum cholesterol levels in a subject, said method comprising administering to a subject in need thereof an effective amount of at least one isolated anti-PCSK9 antibodies or fragments according to the invention simultaneously or sequentially with an agent that decreases cholesterol absorption in the intestine. In some embodiments, the agent that decreases cholesterol absorption in the intestine is ezetimibe.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with at least one other agent, wherein the combination allows for mitigation of undesirable side-effects of at least one other agent. In some embodiments, the anti-PCSK9 antibodies or fragments according to the invention and the at least one other agent are administered concurrently. In some embodiments, the antibody or antibody fragment according to the invention and at least one other agent are not administered simultaneously, with the anti-PCSK9 antibodies or fragments according to the invention being administered before or after the at least one other agent is administered.

In some aspects, the invention comprises a method of lowering the serum cholesterol level in a subject. The method comprises administering to a subject an effective amount of at least one anti-PCSK9 antibody or fragment according to the invention.

In some aspects, the invention comprises a method of lowering serum cholesterol levels in a subject comprising administering to a subject an effective amount of at least one anti-PCSK9 antibody or fragment according to the invention, simultaneously or sequentially with an agent that reduces cholesterol and which optionally further optionally elevates the availability of LDLR protein. In some embodiments, the agent that reduces cholesterol and which may further elevate the availability of LDLR protein comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of lowering serum cholesterol levels in a subject comprising administering to a subject an effective amount of at least one anti-PCSK9 antibody or fragment according to the invention, simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of lowering serum cholesterol levels in a subject comprising administering to a subject an effective amount of at least one anti-PCSK9 antibody or fragment according to the invention, simultaneously or sequentially with a bile acid sequestering agent. In some embodiments, the bile acid sequestering agent is selected from the group consisting of cholestyramine, colesevelam, colestipol, and some combination thereof.

In some aspects, the invention comprises a method of lowering serum cholesterol levels in a subject comprising administering to a subject an effective amount of at least one at least one anti-PCSK9 antibody or fragment according to the invention, simultaneously or sequentially with an agent that decreases cholesterol absorption in the intestine. In some embodiments, the agent that decreases cholesterol absorption in the intestine is ezetimibe.

In some aspects, the invention comprises a method of lowering serum cholesterol levels in a subject comprising administering to a subject an effective amount of at least anti-PCSK9 antibody or fragment according to the invention, simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of lowering serum cholesterol levels in a subject comprising administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of lowering serum cholesterol levels in a subject comprising administering to a subject an effective amount of at least one anti-PCSK9 antibody or fragment according to the invention, simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of lowering serum cholesterol levels in a subject comprising administering to a subject an effective amount of at least one anti-PCSK9 antibody or fragment according to the invention, simultaneously or sequentially with an agent that decreases lipid absorption in the intestine. In some embodiments, the agent that decreases lipid absorption in the intestine is selected from the group consisting of orlistat, lipstatin, and some combination thereof or another known in the art.

In some aspects, the invention comprises a method of lowering serum cholesterol levels in a subject comprising administering to a subject an effective amount of at least one anti-PCSK9 antibody or fragment according to the invention, simultaneously or sequentially with an agent that is an anti-hypertensive and/or treats angina. In some embodiments, the agent that is an anti-hypertensive and/or treats angina is amlodipine or another anti-hypertensive such as those disclosed herein and known in the art.

In some aspects, the invention comprises a method of lowering serum cholesterol levels in a subject comprising administering to a subject an effective amount of at least one anti-PCSK9 antibody or fragment according to the invention, simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the anti-PCSK9 antibody or fragment according to the invention and at least one other agent are not administered simultaneously, with the antibody or antibody fragment according to the invention being administered before or after the at least one other agent is administered.

In some aspects, the invention comprises a method of increasing LDLR protein levels in a subject by administering to a subject an effective amount of at least one anti-PCSK9 antibody or fragment according to the invention as provided herein.

In some aspects, the invention comprises a method of increasing LDLR protein levels in a subject by administering to a subject an effective amount of at least one antibody or antibody fragment according to the invention simultaneously or sequentially with an agent that elevates the availability of LDLR protein. In some embodiments, the agent that elevates the availability of LDLR protein levels comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof or another statin known in the art. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of increasing LDLR protein levels in a subject by administering to a subject an effective amount of at least one antibody or antibody fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of increasing LDLR protein levels in a subject by administering to a subject an effective amount of at least one antibody or antibody fragment according to the invention simultaneously or sequentially with a bile acid sequestering agent. In some embodiments, the bile acid sequestering agent is selected from the group consisting of cholestyramine, colesevelam, colestipol, and some combination thereof.

In some aspects, the invention comprises a method of increasing LDLR protein levels in a subject by administering to a subject an effective amount of at least one antibody or antibody fragment according to the invention simultaneously or sequentially with an agent that decreases cholesterol absorption in the intestine. In some embodiments, the agent that decreases cholesterol absorption in the intestine is ezetimibe.

In some aspects, the invention comprises a method of increasing LDLR protein levels in a subject by administering to a subject an effective amount of at least one antibody or antibody fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of increasing LDLR protein levels in a subject by administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of increasing LDLR protein levels in a subject by administering to a subject an effective amount of at least one antibody or antibody fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of increasing LDLR protein levels in a subject by administering to a subject an effective amount of at least one antibody or antibody fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method of increasing LDLR protein levels in a subject by administering to a subject an effective amount of at least one antibody or antibody fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method of increasing LDLR protein levels in a subject by administering to a subject an effective amount of at least one antibody or antibody fragment according to the invention simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspects, the invention comprises a neutralizing antibody or antibody fragment that binds to PCSK9 and reduces the low density lipoprotein receptor (LDLR) lowering effect of PCSK9 on LDLR. In some embodiments, the antibody or antibody fragment specifically binds to PCSK9. In some embodiments, the antibody or fragment binds to the catalytic domain of PCSK9.

In another embodiment of the invention humanized versions of the inventive antibodies may be derived from rabbit antibodies, using the humanization methods disclosed herein or other known humanization methods.

In particular, the invention contemplates any anti-PCSK9 antibody that contains at least one, two, three, four, five or all six of the CDRs of the anti-PCSK9 antibodies exemplified herein, as well as anti-PCSK9 antibodies and antibody fragments containing VH and/or VL regions which are at least 80, 90, 95, 96, 97, 98 or 99% identical to the VH and/or VL regions of any of the anti-PCSK9 antibodies or antibody fragments exemplified herein. In addition the invention contemplates polynucleotides encoding any anti-PCSK9 antibody that contains at least one, two, three, four, five or all six of the CDRs of the anti-PCSK9 antibodies exemplified herein, as well as anti-PCSK9 antibodies and antibody fragments containing VH and/or VL regions which are at least 80, 90, 95, 96, 97, 98 or 99% identical to the VH and/or VL regions of any of the anti-PCSK9 antibodies or antibody fragments exemplified herein, and host cells containing, i.e., antibodies or fragments capable of binding to PCSK9 and/or PCSK9/LDLR complexes.

The invention also contemplates conjugates of anti-PCSK9 antibodies and binding fragments thereof which may conjugated to one or more effector moiety, e.g., a detectable moiety. The invention also contemplates methods of making anti-PCSK9 antibodies and fragments including, but are not limited to, Fab, Fab', F(ab')2, Fv, scFv fragments, SMIPs (small molecule immunopharmaceuticals), camelbodies, nanobodies, monovalent antibodies such as MetMabs and IgNAR.

In some aspects, the invention comprises a pharmaceutical or diagnostic composition comprising at least one isolated antibody or antibody fragment according to the invention. In some embodiments, the pharmaceutical or diagnostic composition further comprises a pharmaceutically acceptable diluent, carrier, solubilizer, emulsifier, preservative, or a mixture thereof. In some embodiments, the pharmaceutical or diagnostic composition further comprises at least one therapeutic agent for inflammation. In certain embodiments, the therapeutic agent for inflammation comprises a cyclooxygenase type 1 inhibitor, a cyclooxygenase type 2 inhibitor, a small molecule modulator of p38-MAPK, a small molecule modulator of intracellular molecules involved in inflammation pathways, or mixtures thereof. In other embodiments, the pharmaceutical or diagnostic composition is lyophilized.

In some aspects, the invention comprises a method of making any of the antibody or antibody fragments containing any of the VH, VL or CDR amino acid sequences disclosed herein in a recombinant host cell, e.g., a yeast, fungi, mammalian cell, insect cell, bacterium, avian cell or egg, or a plant cell, and preferably a yeast, filamentous fungus or mammalian cell.

This includes by way of example bacterial, fungal, yeast, mammalian, insect, plant and avian cells. Preferred host cells are yeast, fungi, especially filamentous fungi and mammalian cells. Yeast and filamentous fungi include, but are not limited to *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa.*

Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/–DHFR(CHO, Urlaub and Chasin, Proc. Natl. Acad. Sci. USA, 77:4216 (1980)); mouse sertoli cells (TM4, Mather, Biol. Reprod., 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art. Preferred mammalian cells for antibody expression include CHO cells and COS cells. In an exemplary embodiment the recombinant host cells are polyploidal yeast cells of the genus *Pichia.*

In an exemplary embodiment the host cell will comprise a *Pichia pastoris* cell, preferably diploidal. In preferred embodiment the host cell will secrete the anti-PCSK9 antibody or fragment into the culture medium containing host cells, e.g., *Pichia pastoris*, at concentrations which are at least 10-25 mg/liter of said antibody.

Methods for producing recombinant host cells, e.g., yeast, fungi, mammalian cells, insect cells, plant cells, avian cells, bacteria, et al., that contain heterologous antibody coding sequences and which express and secrete functional antibodies are well known. In an exemplary embodiment the host cells that express the antibodies or fragments according to the invention are diploidal *Pichia pastoris*. However, other yeast or fungi, including haploid forms, may be used.

If using diploid *Pichia*, these methods in general comprise producing a recombinant diploidal yeast or fungal cell that expresses and secretes the antibody by: (i) introducing at least one expression vector containing one or more heterologous polynucleotides encoding the variable regions and optionally the constant regions of said antibody or antibody fragment, which sequences are operably linked to a promoter and a signal sequence into a host cell, e.g., a haploid yeast or fungal cell; (ii) producing by mating or spheroplast fusion a polyploidal yeast or fungi from said first and/or second haploid yeast or fungal cells; (iii) selecting polyploidal yeast or fungal cells that stably express said antibody; and (iv) producing stable polyploidal yeast or fungal cultures from said polyploidal yeast or fungal cells that stably express said antibody into the culture medium.

However, the yeast used may include any of the following genera: *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis;* or *Zygosaccharomyces*. In certain embodiments, the yeast genera is *Pichia*. In certain embodiments, the species of *Pichia* is selected from *Pichia pastoris, Pichia methanolica* or *Hansenula polymorpha* (*Pichia angusta*). Suitable filamentous fungi which may be used to express the subject antibodies or fragments are identified supra.

More specifically, the invention contemplates methods of making any anti-PCSK9 antibody or fragment containing any of the VH, VL or CDR amino acid sequences disclosed herein in a recombinant cell, wherein the recombinant cell comprises a heterologous polynucleotide encoding an anti-PCSK9 antibody containing a VH amino acid sequence at least 80, 85, 90, 95, 96, 97, 98 or 99% identical to any of the VH amino acid sequences in SEQ ID NO: 12, SEQ ID NO: 52, SEQ ID NO: 92, SEQ ID NO: 132, SEQ ID NO: 172, SEQ ID NO: 212, SEQ ID NO: 252, SEQ ID NO: 292, SEQ ID NO: 332, SEQ ID NO: 372, SEQ ID NO: 412, SEQ ID NO: 452, SEQ ID NO: 492, SEQ ID NO: 532, SEQ ID NO: 572, SEQ ID NO: 612, SEQ ID NO: 652, SEQ ID NO: 692; SEQ ID NO: 732, SEQ ID NO: 772, SEQ ID NO: 812, SEQ ID NO: 852, SEQ ID NO: 892, or SEQ ID NO: 932 or encoding a variant thereof wherein at least one framework residue (FR residue) or CDR residue has been altered, e.g., substituted with an amino acid present at the corresponding position in a rabbit anti-PCSK9 antibody VH polypeptide or a conservative amino acid substitution.

In other embodiments, the heterologous polynucleotide further comprises a polynucleotide sequence encoding an anti-PCSK9 VL amino acid sequence at least 80, 85, 90, 95, 96, 97, 98 or 99% identical to any of the VL amino acid sequences in SEQ ID NO: 32, SEQ ID NO: 72, SEQ ID NO: 112, SEQ ID NO: 152, SEQ ID NO: 192, SEQ ID NO: 232, SEQ ID NO: 272, SEQ ID NO: 312, SEQ ID NO: 352, SEQ ID NO: 392, SEQ ID NO: 432, SEQ ID NO: 472, SEQ ID NO: 512, SEQ ID NO: 542, SEQ ID NO: 582, SEQ ID NO: 622, SEQ ID NO: 662, SEQ ID NO: 702, SEQ ID NO: 742, SEQ ID NO: 782, SEQ ID NO: 822, SEQ ID NO: 862, SEQ ID NO: 902, or SEQ ID NO: 942 or encoding a variant thereof wherein at least one framework residue (FR residue) or CDR residue has been altered, e.g., substituted with an amino acid present at the corresponding position in a rabbit anti-PCSK9 antibody VL polypeptide or a conservative amino acid substitution. In other embodiments, the heterologous polynucleotide comprises a sequence encoding VH and VL polypeptides at least 80, 85, 90, 95, 96, 97, 98 or 99% identical to any of the VH and VL amino acid sequences in contained in SEQ ID NO: 12 and SEQ ID NO: 32; SEQ ID NO: 52 and SEQ ID NO: 72; SEQ ID NO: 92 and SEQ ID NO: 112; SEQ ID NO: 132 and SEQ ID NO: 152; SEQ ID NO: 172 and SEQ ID NO: 192; SEQ ID NO: 212 and SEQ ID NO: 232; SEQ ID NO: 252 and SEQ ID NO: 272; SEQ ID NO: 292 and SEQ ID NO: 312; SEQ ID NO: 332 and SEQ ID NO: 352; SEQ ID NO: 372 and SEQ ID NO: 392; SEQ ID NO: 412 and SEQ ID NO: 432; SEQ ID NO: 452 and SEQ ID NO: 472; SEQ ID NO: 492 and SEQ ID NO: 512; SEQ ID NO: 532 and SEQ ID NO: 552; SEQ ID NO: 572 and SEQ ID NO: 592; SEQ ID NO: 612 and SEQ ID NO: 632; SEQ ID NO: 652 and SEQ ID NO: 672; SEQ ID NO: 692 and SEQ ID NO: 712; SEQ ID NO: 732 and SEQ ID NO: 752; SEQ ID NO: 772 and SEQ ID NO: 792; SEQ ID NO: 812 and SEQ ID NO: 832; SEQ ID NO: 852 and SEQ ID NO: 872; SEQ ID NO: 892 and SEQ ID NO: 912; SEQ ID NO: 932 and SEQ ID NO: 952; or any combination of VH and VL sequences which are at least 80, 85, 90, 95, 96, 97, 98 or 99% identical to any of the VH and VL amino acid sequences exemplified herein.

In other embodiments, the heterologous polynucleotide encodes an anti-PCSK9 antibody or fragment wherein the antibody or fragment contains at least one CDR, at two or all three of the CDRs contained in a VL polypeptide and/or at least one CDR, two or all three of the CDRs contained in a VH polypeptide, wherein said VH and VL polypeptide sequences are selected from those in SEQ ID NO: 12, SEQ ID NO: 32; SEQ ID NO: 52, SEQ ID NO: 72; SEQ ID NO: 92, SEQ ID NO: 112; SEQ ID NO: 132, SEQ ID NO: 152; SEQ ID NO: 172, SEQ ID NO: 192; SEQ ID NO: 212, SEQ ID NO: 232, SEQ ID NO: 252, SEQ ID NO: 272; SEQ ID NO: 292, SEQ ID NO: 312; SEQ ID NO: 332, SEQ ID NO: 352; SEQ ID NO: 372, SEQ ID NO: 392; SEQ ID NO: 412, SEQ ID NO: 432; SEQ ID NO: 452, SEQ ID NO: 472; SEQ ID NO: 492, SEQ ID NO: 512; SEQ ID NO: 532; SEQ ID NO: 552; SEQ ID NO: 572; SEQ ID NO: 592; SEQ ID NO: 612; SEQ ID NO: 632; SEQ ID NO: 652; SEQ ID NO: 672; SEQ ID NO: 692; SEQ ID NO: 712; SEQ ID NO: 732; SEQ ID NO: 752; SEQ ID NO: 772; SEQ ID NO: 792; SEQ ID NO: 812; SEQ ID NO: 832; SEQ ID NO: 852; SEQ ID NO: 872; SEQ ID NO: 892; SEQ ID NO: 912; SEQ ID NO: 932; SEQ ID NO: 952; or mixtures thereof.

In some aspects, the invention comprises an isolated polynucleotide comprising a polynucleotide encoding an anti-PCSK9 VH antibody amino acid sequence at least 80, 85, 90, 95, 96, 97, 98, or 99% identical or identical to the VH polypeptide sequences in SEQ ID NO: 12, SEQ ID NO: 52, SEQ ID NO: 92, SEQ ID NO: 132, SEQ ID NO: 172, SEQ ID NO: 212, SEQ ID NO: 252, SEQ ID NO: 292, SEQ ID NO: 332, SEQ ID NO: 372, SEQ ID NO: 412, SEQ ID NO: 452, SEQ ID NO: 492, SEQ ID NO: 532, SEQ ID NO: 572, SEQ ID NO: 612, SEQ ID NO: 652, SEQ ID NO: 692, SEQ ID NO: 732, SEQ ID NO: 772, SEQ ID NO: 812, SEQ ID NO: 852, SEQ ID NO: 892, or SEQ ID NO: 932, or encoding a variant thereof wherein at least one framework residue (FR residue) or CDR residue has been altered, e.g., substituted with an amino acid present at the corresponding position in a rabbit anti-PCSK9 antibody VH polypeptide or a conservative amino acid substitution. In other embodiments, the invention comprises a vector comprising the polynucleotide sequence above. In other embodiments, the invention comprises a host cell comprising the vector mentioned above. In certain embodiments, the host cell mentioned above is a yeast cell belonging to the genus *Pichia*.

In some aspects, the invention comprises an isolated polynucleotide comprising the polynucleotide sequence encoding an anti-PCSK9 VL antibody amino acid sequence at least 80, 85, 90, 95, 96, 97, 98 or 99% identical or identical to any one of those in SEQ ID NO: 32, SEQ ID NO: 72, SEQ ID NO: 112, SEQ ID NO: 152, SEQ ID NO: 192, SEQ ID NO: 232, SEQ ID NO: 272, SEQ ID NO: 312, SEQ ID NO: 352, SEQ ID NO: 392, SEQ ID NO: 432, SEQ ID NO: 472, SEQ ID NO: 512, SEQ ID NO: 552, or SEQ ID NO: 592, SEQ ID NO: 632, SEQ ID NO: 672, SEQ ID NO: 712, SEQ ID NO: 752, SEQ ID NO: 792, SEQ ID NO: 832, SEQ ID NO: 872, SEQ ID NO: 912, or SEQ ID NO: 952, or encoding a variant thereof wherein at least one framework residue (FR residue) or CDR residue has been altered, e.g., substituted with an amino acid present at the corresponding position in a rabbit anti-PCSK9 antibody VL polypeptide or a conservative amino acid substitution. In other embodiments, the invention comprises a vector comprising any combination of the polynucleotide sequence above. In certain embodiments, the invention comprises a host cell comprising one or more vectors containing any of the polynucleotides mentioned above. In certain embodiments, the invention embraces a host cell containing any of the afore-mentioned polynucleotides or a vector containing, e.g., a yeast, fungal, insect, plant, avian, bacterial or mammalian cell, and in an exemplary embodiment a yeast cell belonging to the genus *Pichia*.

In some aspects, the invention comprises an isolated nucleic acid comprising a polynucleotide that hybridizes under stringent conditions to SEQ ID NO: 12, SEQ ID NO: 32; SEQ ID NO: 52, SEQ ID NO: 72; SEQ ID NO: 92, SEQ ID NO: 112; SEQ ID NO: 132, SEQ ID NO: 152; SEQ ID NO: 172, SEQ ID NO: 192; SEQ ID NO: 212, SEQ ID NO: 232, SEQ ID NO: 252, SEQ ID NO: 272; SEQ ID NO: 292, SEQ ID NO: 312; SEQ ID NO: 332, SEQ ID NO: 352; SEQ ID NO: 372, SEQ ID NO: 392; SEQ ID NO: 412; SEQ ID NO: 432; SEQ ID NO: 452; SEQ ID NO: 472; SEQ ID NO: 492; SEQ ID NO: 512; SEQ ID NO: 532; SEQ ID NO: 552; SEQ ID NO: 572; SEQ ID NO: 592; SEQ ID NO: 612; SEQ ID NO: 632; SEQ ID NO: 652; SEQ ID NO: 672; SEQ ID NO: 692; SEQ ID NO: 712; SEQ ID NO: 732; SEQ ID NO: 752; SEQ ID NO: 772; SEQ ID NO: 792; SEQ ID NO: 812; SEQ ID NO: 832; SEQ ID NO: 852; SEQ ID NO: 872; SEQ ID NO: 892; SEQ ID NO: 912; SEQ ID NO: 932; SEQ ID NO: 952; a codon degenerate thereof; or mixtures thereof, which encodes the VH or VL region of an antibody that binds PCSK9.

The invention also pertains to the use of anti-PCSK9 antibodies and binding fragments thereof containing or encoded by any of the afore-mentioned amino acid or polynucleotides sequences and variants thereof for the diagnosis, assessment and treatment of any of the diseases and disorders disclosed herein, i.e., especially disorders associated with PCSK9 or aberrant expression thereof.

The invention also contemplates the use of fragments of anti-PCSK9 antibodies and binding fragments thereof containing or encoded by any of the afore-mentioned amino acid or polynucleotides sequences and variants thereof for the diagnosis, assessment and treatment of diseases and disorders associated with PCSK9 or aberrant expression thereof. Other specific embodiments of the invention relate to the production of anti-PCSK9 antibodies or fragments thereof in mammalian cells such as CHO, NSO or HEK 293 cells, or yeast cells (for example diploid yeast such as diploid *Pichia*) and other yeast strains.

BRIEF DESCRIPTION OF THE SEVERAL VIEWS OF THE DRAWINGS

FIGS. 1A-1G provide the polypeptide sequences of the full-length heavy chain for antibodies Ab1-Ab24 aligned by their framework regions (FR), complementarity determining regions (CDRs), and constant regions.

FIGS. 2A-2D provide the polypeptide sequences of the full-length light chain for antibodies Ab1-Ab24 aligned by their framework regions (FR), complementarity determining regions (CDRs), and constant regions.

FIG. 3A-3S provide the polynucleotide sequences encoding the full-length heavy chain for antibodies Ab1-Ab24 aligned by their framework regions (FR), complementarity determining regions (CDRs), and constant regions.

FIG. 4A-4J provide the polynucleotide sequences encoding the full-length light chain for antibodies Ab1-Ab24 aligned by their framework regions (FR), complementarity determining regions (CDRs), and constant regions.

FIG. 5 provides the polypeptide sequence coordinates for the variable region and complementarity determining regions (CDRs) of the heavy chain for antibodies Ab1-Ab24.

FIG. 6 provides the polypeptide sequence coordinates for the constant region and framework regions (FR) of the heavy chain for antibodies Ab1-Ab24.

FIG. 7 provides the polypeptide sequence coordinates for the variable region and complementarity determining regions (CDRs) of the light chain for antibodies Ab1-Ab24.

FIG. 8 provides the polypeptide sequence coordinates for the constant region and framework regions (FR) of the light chain for antibodies Ab1-Ab24.

FIG. 9 provides the polynucleotide sequence coordinates for the variable region and complementarity determining regions (CDRs) of the heavy chain for antibodies Ab1-Ab24.

FIG. 10 provides the polynucleotide sequence coordinates for the constant region and framework regions (FR) of the heavy chain for antibodies Ab1-Ab24.

FIG. 11 provides the polynucleotide sequence coordinates for the variable region and complementarity determining regions (CDRs) of the light chain for antibodies Ab1-Ab24.

FIG. 12 provides the polynucleotide sequence coordinates for the constant region and framework regions (FR) of the light chain for antibodies Ab1-Ab24.

FIG. 13 provides the binding data for anti-PCSK9 antibodies to human PCSK9, obtained following the protocol in Example 1 infra for antibodies Ab1, Ab2, Ab3, and Ab4.

FIG. 14 provides the binding data for anti-PCSK9 antibodies to human PCSK9, obtained following the protocol in Example 1 infra for antibodies Ab5, Ab6, Ab8, and Ab9.

FIG. 15 provides the binding data for anti-PCSK9 antibodies to human PCSK9, obtained following the protocol in Example 1 infra for antibodies Ab7, Ab10, and Ab13.

FIG. 16 provides the binding data for anti-PCSK9 antibodies to human PCSK9, obtained following the protocol in Example 1 infra for antibodies Ab11 and Ab12.

FIG. 17 provides the binding data for anti-PCSK9 antibodies to human PCSK9, obtained following the protocol in Example 1 infra for antibody Ab14.

FIG. 18 provides the binding data for anti-PCSK9 antibodies to human PCSK9, obtained following the protocol in Example 1 infra for antibody Ab15.

FIG. 19 provides the binding data for anti-PCSK9 antibodies to human PCSK9, obtained following the protocol in Example 1 infra for antibodies Ab16 and Ab17.

FIG. 20 provides the binding data for anti-PCSK9 antibodies to human PCSK9, obtained following the protocol in Example 1 infra for antibody Ab18.

FIG. 21 provides the binding data for anti-PCSK9 antibodies to human PCSK9, obtained following the protocol in Example 1 infra for antibody Ab19.

FIG. 22 provides the binding data for anti-PCSK9 antibodies to human PCSK9, obtained following the protocol in Example 1 infra for antibody Ab20.

FIG. 23 provides the binding data for anti-PCSK9 antibodies to human PCSK9, obtained following the protocol in Example 1 infra for antibody Ab21.

FIG. 24 provides the binding data for anti-PCSK9 antibodies to human PCSK9, obtained following the protocol in Example 1 infra for antibody Ab22.

FIG. 25 provides the binding data for anti-PCSK9 antibodies to human PCSK9, obtained following the protocol in Example 1 infra for antibody Ab23.

FIG. 26 provides the binding data for anti-PCSK9 antibodies to human PCSK9, obtained following the protocol in Example 1 infra for antibody Ab24.

FIG. 27 provides LDL-C uptake inhibition data obtained following the protocol in Example 1 infra for antibody Ab1.

FIG. 28 provides LDL-C uptake inhibition data obtained following the protocol in Example 1 infra for antibody Ab2.

FIG. 29 provides LDL-C uptake inhibition data obtained following the protocol in Example 1 infra for antibody Ab3.

FIG. 30 provides LDL-C uptake inhibition data obtained following the protocol in Example 1 infra for antibody Ab4.

FIG. 31 provides LDL-C uptake inhibition data obtained following the protocol in Example 1 infra for antibody Ab5.

FIG. 32 provides uptake inhibition data obtained following the protocol in Example 1 infra for antibodies Ab6 and Ab7.

FIG. 33 provides LDL-C uptake inhibition data obtained following the protocol in Example 1 infra for antibody Ab8.

FIG. 34 provides LDL-C uptake inhibition data obtained following the protocol in Example 1 infra for antibody Ab9.

FIG. 35 provides LDL-C uptake inhibition data obtained following the protocol in Example 1 infra for antibodies Ab10, Ab11, and Ab12.

FIG. 36 provides LDL-C uptake inhibition data obtained following the protocol in Example 1 infra for antibody Ab13.

FIG. 37 provides LDL-C uptake inhibition data obtained following the protocol in Example 1 infra for antibody Ab14.

FIG. 38 provides LDL-C uptake inhibition data obtained following the protocol in Example 1 infra for antibody Ab15.

FIG. 39 provides LDL-C uptake inhibition data obtained following the protocol in Example 1 infra for antibodies Ab16 and Ab17.

FIG. 40 provides LDL-C uptake inhibition data obtained following the protocol in Example 1 infra for antibody Ab18.

FIG. 41 provides LDL-C uptake inhibition data obtained following the protocol in Example 1 infra for antibody Ab19.

FIG. 42 provides LDL-C uptake inhibition data obtained following the protocol in Example 1 infra for antibody Ab20.

FIG. 43 provides LDL-C uptake inhibition data obtained following the protocol in Example 1 infra for antibody Ab21.

FIG. 44 provides LDL-C uptake inhibition data obtained following the protocol in Example 1 infra for antibody Ab22.

FIG. 45 provides LDL-C uptake inhibition data obtained following the protocol in Example 1 infra for antibody Ab23.

FIG. 46 provides LDL-C uptake inhibition data obtained following the protocol in Example 1 infra for antibody Ab24.

FIG. 47 provides the binding data for anti-PCSK9 antibodies to cynomolgus monkey PCSK9, obtained following the protocol in Example 1 infra for antibodies Ab1, Ab2, Ab3, and Ab4.

FIG. 48 provides the binding data for anti-PCSK9 antibodies to cynomolgus monkey PCSK9, obtained following the protocol in Example 1 infra for antibodies Ab5, Ab6, Ab7, and Ab8.

FIG. 49 provides the binding data for anti-PCSK9 antibodies to cynomolgus monkey PCSK9, obtained following the protocol in Example 1 infra for antibodies Ab9, Ab10, Ab11, and Ab12.

FIG. 50 provides the binding data for anti-PCSK9 antibodies to cynomolgus monkey PCSK9, obtained following the protocol in Example 1 infra for antibody Ab13.

FIG. 51 provides the binding data for anti-PCSK9 antibodies to cynomolgus monkey PCSK9, obtained following the protocol in Example 1 infra for antibody Ab14.

FIG. 52 provides the binding data for anti-PCSK9 antibodies to cynomolgus monkey PCSK9, obtained following the protocol in Example 1 infra for antibody Ab15.

FIG. 53 provides the binding data for anti-PCSK9 antibodies to cynomolgus monkey PCSK9, obtained following the protocol in Example 1 infra for antibodies Ab16 and Ab17.

FIG. 54 provides the binding data for anti-PCSK9 antibodies to cynomolgus monkey PCSK9, obtained following the protocol in Example 1 infra for antibody Ab18.

FIG. 55 provides the binding data for anti-PCSK9 antibodies to cynomolgus monkey PCSK9, obtained following the protocol in Example 1 infra for antibody Ab19.

FIG. 56 provides the binding data for anti-PCSK9 antibodies to cynomolgus monkey PCSK9, obtained following the protocol in Example 1 infra for antibody Ab20.

FIG. 57 provides the binding data for anti-PCSK9 antibodies to cynomolgus monkey PCSK9, obtained following the protocol in Example 1 infra for antibody Ab21.

FIG. 58 provides the binding data for anti-PCSK9 antibodies to cynomolgus monkey PCSK9, obtained following the protocol in Example 1 infra for antibody Ab22.

FIG. 59 provides the binding data for anti-PCSK9 antibodies to cynomolgus monkey PCSK9, obtained following the protocol in Example 1 infra for antibody Ab23.

FIG. 60 provides the binding data for anti-PCSK9 antibodies to cynomolgus monkey PCSK9, obtained following the protocol in Example 1 infra for antibody Ab24.

FIG. 61 provides the inhibition data for anti-PCSK9 antibodies to block the interaction of PCSK9 with LDLR, obtained following the protocol in Example 6 infra for antibody Ab1.

FIG. 62 provides the inhibition data for anti-PCSK9 antibodies to block the interaction of PCSK9 with LDLR, obtained following the protocol in Example 6 infra for antibody Ab2.

FIG. 63 provides the inhibition data for anti-PCSK9 antibodies to block the interaction of PCSK9 with LDLR, obtained following the protocol in Example 6 infra for antibody Ab3.

FIG. 64 provides the inhibition data for anti-PCSK9 antibodies to block the interaction of PCSK9 with LDLR, obtained following the protocol in Example 6 infra for antibody Ab4.

FIG. 65 provides the inhibition data for anti-PCSK9 antibodies to block the interaction of PCSK9 with LDLR, obtained following the protocol in Example 6 infra for antibody Ab5.

FIG. 66 provides the inhibition data for anti-PCSK9 antibodies to block the interaction of PCSK9 with LDLR, obtained following the protocol in Example 6 infra for antibody Ab6.

FIG. 67 provides the inhibition data for anti-PCSK9 antibodies to block the interaction of PCSK9 with LDLR, obtained following the protocol in Example 6 infra for antibody Ab7.

FIG. 68 provides the inhibition data for anti-PCSK9 antibodies to block the interaction of PCSK9 with LDLR, obtained following the protocol in Example 6 infra for antibody Ab8.

FIG. 69 provides the inhibition data for anti-PCSK9 antibodies to block the interaction of PCSK9 with LDLR, obtained following the protocol in Example 6 infra for antibody Ab9.

FIG. 70 provides the inhibition data for anti-PCSK9 antibodies to block the interaction of PCSK9 with LDLR, obtained following the protocol in Example 6 infra for antibody Ab10.

FIG. 71 provides the inhibition data for anti-PCSK9 antibodies to block the interaction of PCSK9 with LDLR, obtained following the protocol in Example 6 infra for antibody Ab11.

FIG. 72 provides the inhibition data for anti-PCSK9 antibodies to block the interaction of PCSK9 with LDLR, obtained following the protocol in Example 6 infra for antibody Ab12.

FIG. 73 provides the inhibition data for anti-PCSK9 antibodies to block the interaction of PCSK9 with LDLR, obtained following the protocol in Example 6 infra for antibody Ab13.

FIG. 74 provides the inhibition data for anti-PCSK9 antibodies to block the interaction of PCSK9 with LDLR, obtained following the protocol in Example 6 infra for antibody Ab14.

FIG. 75 provides the inhibition data for anti-PCSK9 antibodies to block the interaction of PCSK9 with LDLR, obtained following the protocol in Example 6 infra for antibody Ab15.

FIG. 76 provides the inhibition data for anti-PCSK9 antibodies to block the interaction of PCSK9 with LDLR, obtained following the protocol in Example 6 infra for antibody Ab16.

FIG. 77 provides the inhibition data for anti-PCSK9 antibodies to block the interaction of PCSK9 with LDLR, obtained following the protocol in Example 6 infra for antibody Ab17.

FIG. 78 provides the inhibition data for anti-PCSK9 antibodies to block the interaction of PCSK9 with LDLR, obtained following the protocol in Example 6 infra for antibody Ab18.

FIG. 79 provides the inhibition data for anti-PCSK9 antibodies to block the interaction of PCSK9 with LDLR, obtained following the protocol in Example 6 infra for antibody Ab19.

FIG. 80 provides the inhibition data for anti-PCSK9 antibodies to block the interaction of PCSK9 with LDLR, obtained following the protocol in Example 6 infra for antibody Ab20.

FIG. 81 provides the inhibition data for anti-PCSK9 antibodies to block the interaction of PCSK9 with LDLR, obtained following the protocol in Example 6 infra for antibody Ab21.

FIG. 82 provides the inhibition data for anti-PCSK9 antibodies to block the interaction of PCSK9 with LDLR, obtained following the protocol in Example 6 infra for antibody Ab22.

FIG. 83 provides the inhibition data for anti-PCSK9 antibodies to block the interaction of PCSK9 with LDLR, obtained following the protocol in Example 6 infra for antibody Ab23.

FIG. 84 provides the inhibition data for anti-PCSK9 antibodies to block the interaction of PCSK9 with LDLR, obtained following the protocol in Example 6 infra for antibody Ab24.

FIG. 85 provides data showing the serum LDL-C cholesterol level in cynomolgus monkeys injected with Ab18.

FIG. 86 provides data showing the serum total cholesterol level in cynomolgus monkeys injected with Ab18 as a percentage change from pre-dose levels.

FIG. 87 provides data showing the serum HDL cholesterol level in cynomolgus monkeys injected with Ab18 as a percentage change from pre-dose levels.

FIG. 88 provides data showing the serum LDL-C cholesterol level in cynomolgus monkeys injected with Ab11 as a percentage change from pre-dose levels.

FIG. 89 provides data showing the serum total cholesterol level in cynomolgus monkeys injected with Ab11 as a percentage change from pre-dose levels.

FIG. 90 provides data showing the serum HDL cholesterol level in cynomolgus monkeys injected with Ab11 as a percentage change from pre-dose levels.

FIG. 91 provides data showing the serum LDL-C cholesterol level in cynomolgus monkeys injected with Ab19 as a percentage change from pre-dose levels.

FIG. 92 provides data showing the serum LDL-C cholesterol level in cynomolgus monkeys injected with Ab20 as a percentage change from pre-dose levels.

FIG. 93 provides data showing the serum LDL-C cholesterol level in cynomolgus monkeys injected with Ab22 as a percentage change from pre-dose levels.

FIG. 94 provides data showing the serum LDL-C cholesterol level in cynomolgus monkeys injected with Ab24 as a percentage change from pre-dose levels.

PREFERRED EMBODIMENTS OF THE INVENTION

Different preferred embodiments of the invention are listed below and are further described in more detail in the Detailed Written Description and in the Examples section of this application.

A preferred embodiment of the invention relates to an anti-human PCSK9 antibody or antibody fragment that competes with and/or specifically binds to the same or overlapping epitope(s) on human PCSK9 as an anti-human PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human PCSK9 antibody or antibody fragment wherein said antibody or antibody fragment pacifically binds to the same or overlapping epitope(s) on human PCSK9 as an anti-human PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human PCSK9 antibody or antibody fragment wherein said epitope(s) are identified using a binding assay that detects the binding of said anti-human PCSK9 antibody to one or more peptides in a library of 10-15-mer peptides which are overlapping peptide fragments of human PCSK9 that correspond to all or substantially all of the length of the human PCSK9 polypeptide.

Another preferred embodiment of the invention relates to an anti-human PCSK9 antibody or antibody fragment, wherein said binding assay is a Western immunoblot assay which detects specific binding of the antibody or antibody fragment to one or more of said 10-15 mer peptides in said library by the use of a chemiluminescent label which emits a detectable chemiluminescent signal when specific binding of said antibody or antibody fragment to a peptide in said library occurs.

Another preferred embodiment of the invention relates to an anti-human antibody PCSK9 antibody or antibody fragment wherein said antibody or antibody fragment contains at least 2 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human antibody PCSK9 antibody or antibody fragment, wherein said antibody or antibody fragment contains at least 3 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human antibody PCSK9 antibody or antibody fragment, wherein said antibody or antibody fragment contains at least 4 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human antibody PCSK9 antibody or antibody fragment, wherein said antibody or antibody fragment contains at least 5 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human antibody PCSK9 antibody or antibody fragment, wherein said antibody or antibody fragment contains all 6 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to an anti-human antibody PCSK9 antibody or antibody fragment wherein said antibody or antibody fragment contains (a) a variable heavy chain comprising a CDR1 sequence selected from the group consisting of SEQ ID NO: 4, SEQ ID NO: 44, SEQ ID NO: 84, SEQ ID NO: 124, SEQ ID NO: 164, SEQ ID NO: 204, SEQ ID NO: 244, SEQ ID NO: 284, SEQ ID NO: 324, SEQ ID NO: 364, SEQ ID NO: 404, SEQ ID NO: 444, SEQ ID NO: 484, SEQ ID NO: 524, SEQ ID NO: 564, SEQ ID NO: 604, SEQ ID NO: 644, SEQ ID NO: 684, SEQ ID NO: 724, SEQ ID NO: 764, SEQ ID NO: 804, SEQ ID NO: 844, SEQ ID NO: 884, and SEQ ID NO: 924; a CDR2 sequence selected from the group consisting of SEQ ID NO: 6, SEQ ID NO: 46, SEQ ID NO: 86, SEQ ID NO: 126, SEQ ID NO: 166, SEQ ID NO: 206, SEQ ID NO: 246, SEQ ID NO: 286, SEQ ID NO: 326, SEQ ID NO: 366, SEQ ID NO: 406, SEQ ID NO: 446, SEQ ID NO: 486, SEQ ID NO: 526, SEQ ID NO: 566, SEQ ID NO: 606, SEQ ID NO: 646, SEQ ID NO: 686, SEQ ID NO: 726, SEQ ID NO: 766, SEQ ID NO: 806, SEQ ID NO: 846, SEQ ID NO: 886, and SEQ ID NO: 926; and a CDR3 sequence selected from the group consisting of SEQ ID NO: 8, SEQ ID NO: 48, SEQ ID NO: 88, SEQ ID NO: 128, SEQ ID NO: 168, SEQ ID NO: 208, SEQ ID NO: 248, SEQ ID NO: 288, SEQ ID NO: 328, SEQ ID NO: 368, SEQ ID NO: 408, SEQ ID NO: 448, SEQ ID NO: 488, SEQ ID NO: 528, SEQ ID NO: 568, SEQ ID NO: 608, SEQ ID NO: 648, SEQ ID NO: 688, SEQ ID NO: 728, SEQ ID NO: 768, SEQ ID NO: 808, SEQ ID NO: 848, SEQ ID NO: 888, and SEQ ID NO: 928; and/or (b) a variable light chain comprising a CDR1 sequence selected from the group consisting of SEQ ID NO: 24, SEQ ID NO: 64, SEQ ID NO: 104, SEQ ID NO: 144, SEQ ID NO: 184, SEQ ID NO: 224, SEQ ID NO: 264, SEQ ID NO: 304, SEQ ID NO: 344, SEQ ID NO: 384, SEQ ID NO: 424, SEQ ID NO: 464, SEQ ID NO: 504, SEQ ID NO: 544, SEQ ID NO: 584, SEQ ID NO: 624, SEQ ID NO: 664, SEQ ID NO: 704, SEQ ID NO: 744, SEQ ID NO: 784, SEQ ID NO: 824, SEQ ID NO: 864, SEQ ID NO: 904, and SEQ ID NO: 944; a CDR2 sequence selected from the group consisting of SEQ ID NO: 26, SEQ ID NO: 66, SEQ ID NO: 106, SEQ ID NO: 146, SEQ ID NO: 186, SEQ ID NO: 226, SEQ ID NO: 266, SEQ ID NO: 306, SEQ ID NO: 346, SEQ ID NO: 386, SEQ ID NO: 426, SEQ ID NO: 466, SEQ ID NO: 506, SEQ ID NO: 546, SEQ ID NO: 586, SEQ ID NO: 626, SEQ ID NO: 666, SEQ ID NO: 706, SEQ ID NO: 746, SEQ ID NO: 786, SEQ ID NO: 826, SEQ ID NO: 866, SEQ ID NO: 906, and SEQ ID NO: 946; and a CDR3 sequence selected from the group consisting of SEQ ID NO: 28, SEQ ID NO: 68, SEQ ID NO: 108, SEQ ID NO: 148, SEQ ID NO: 188, SEQ ID NO: 228, SEQ ID NO: 268, SEQ ID NO: 308, SEQ ID NO: 348, SEQ ID NO: 388, SEQ ID NO: 428, SEQ ID NO: 468, SEQ ID NO: 508, SEQ ID NO: 548, SEQ ID NO: 588, SEQ ID NO: 628, SEQ ID NO: 668, SEQ ID NO: 708, SEQ ID NO: 748, SEQ ID NO: 788, SEQ ID NO: 828, SEQ ID NO: 868, SEQ ID NO: 908, and SEQ ID NO: 948, with the further proviso that one or two residues of any of the afore-identified CDR polypeptides may be substituted with another amino acid, preferably a conservative amino acid substitution.

Another preferred embodiment of the invention relates to an anti-human PCSK9 antibody or antibody fragment, wherein the variable heavy chain comprises the CDR1 sequence of SEQ ID NO: 4, the CDR2 sequence of SEQ ID NO: 6, and the CDR3 sequence of SEQ ID NO: 8; and/or the variable light chain comprises the CDR1 sequence of SEQ ID NO: 24, the CDR2 sequence of SEQ ID NO: 26, and the CDR3 sequence of SEQ ID NO: 28.

Another preferred embodiment of the invention relates to an anti-human PCSK9 antibody or antibody fragment wherein the variable heavy chain comprises the CDR1 sequence of SEQ ID NO: 44, the CDR2 sequence of SEQ ID NO: 46, and the CDR3 sequence of SEQ ID NO: 48; and/or the variable light chain comprises the CDR1 sequence of SEQ ID NO: 64, the CDR2 sequence of SEQ ID NO: 66, and the CDR3 sequence of SEQ ID NO: 68.

Another preferred embodiment of the invention relates to an anti-human PCSK9 antibody or antibody fragment wherein the variable heavy chain comprises the CDR1 sequence of SEQ ID NO: 84, the CDR2 sequence of SEQ ID NO: 86, and the CDR3 sequence of SEQ ID NO: 88; and/or the variable light chain comprises the CDR1 sequence of SEQ ID NO: 104, the CDR2 sequence of SEQ ID NO: 106, and the CDR3 sequence of SEQ ID NO: 108.

Another preferred embodiment of the invention relates to an anti-human PCSK9 antibody or antibody fragment, wherein the variable heavy chain comprises the CDR1 sequence of SEQ ID NO: 124, the CDR2 sequence of SEQ ID NO: 126, and the CDR3 sequence of SEQ ID NO: 128; and/or the variable light chain comprises the CDR1 sequence of SEQ ID NO: 144, the CDR2 sequence of SEQ ID NO: 146, and the CDR3 sequence of SEQ ID NO: 148.

Another preferred embodiment of the invention relates to an anti-human PCSK9 antibody or antibody fragment wherein the variable heavy chain comprises the CDR1 sequence of SEQ ID NO: 164, the CDR2 sequence of SEQ ID NO: 166, and the CDR3 sequence of SEQ ID NO: 168; and the variable light chain comprises the CDR1 sequence of SEQ ID NO: 184, the CDR2 sequence of SEQ ID NO: 186, and the CDR3 sequence of SEQ ID NO: 188.

Another preferred embodiment of the invention relates to an anti-human PCSK9 antibody or antibody fragment according to the invention, wherein the variable heavy chain comprises the CDR1 sequence of SEQ ID NO: 204, the CDR2 sequence of SEQ ID NO: 206, and the CDR3 sequence of SEQ ID NO: 208; and the variable light chain comprises the CDR1 sequence of SEQ ID NO: 224, the CDR2 sequence of SEQ ID NO: 226, and the CDR3 sequence of SEQ ID NO: 228.

Another preferred embodiment of the invention relates to an anti-human PCSK9 antibody or antibody fragment, wherein the variable heavy chain comprises the CDR1 sequence of SEQ ID NO: 244, the CDR2 sequence of SEQ ID NO: 246, and the CDR3 sequence of SEQ ID NO: 248; and the variable light chain comprises the CDR1 sequence of SEQ ID NO: 264, the CDR2 sequence of SEQ ID NO: 266, and the CDR3 sequence of SEQ ID NO: 268.

Another preferred embodiment of the invention relates to an anti-human PCSK9 antibody or antibody fragment, wherein the variable heavy chain comprises the CDR1 sequence of SEQ ID NO: 284, the CDR2 sequence of SEQ ID NO: 286, and the CDR3 sequence of SEQ ID NO: 288; and the variable light chain comprises the CDR1 sequence of SEQ ID NO: 304, the CDR2 sequence of SEQ ID NO: 306, and the CDR3 sequence of SEQ ID NO: 308.

Another preferred embodiment of the invention relates to an anti-human PCSK9 antibody or antibody fragment, wherein the variable heavy chain comprises the CDR1 sequence of SEQ ID NO: 324, the CDR2 sequence of SEQ ID NO: 326, and the CDR3 sequence of SEQ ID NO: 328; and/or the variable light chain comprises the CDR1 sequence of SEQ ID NO: 344, the CDR2 sequence of SEQ ID NO: 346, and the CDR3 sequence of SEQ ID NO: 348.

Another preferred embodiments of the invention relates to an anti-human PCSK9 antibody or antibody fragment, wherein the variable heavy chain comprises the CDR1 sequence of SEQ ID NO: 364, the CDR2 sequence of SEQ ID NO: 366, and the CDR3 sequence of SEQ ID NO: 368; and/or the variable light chain comprises the CDR1 sequence of SEQ ID NO: 384, the CDR2 sequence of SEQ ID NO: 386, and the CDR3 sequence of SEQ ID NO: 388.

Another preferred embodiment of the invention relates to an anti-human PCSK9 antibody or antibody fragment wherein the variable heavy chain comprises the CDR1 sequence of SEQ ID NO: 404, the CDR2 sequence of SEQ ID NO: 406, and the CDR3 sequence of SEQ ID NO: 408; and/or the variable light chain comprises the CDR1 sequence of SEQ ID NO: 424, the CDR2 sequence of SEQ ID NO: 426, and the CDR3 sequence of SEQ ID NO: 428.

Another preferred embodiment of the invention relates to an anti-human PCSK9 antibody or antibody fragment, wherein the variable heavy chain comprises the CDR1 sequence of SEQ ID NO: 444, the CDR2 sequence of SEQ ID NO: 446, and the CDR3 sequence of SEQ ID NO: 448; and the variable light chain comprises the CDR1 sequence of SEQ ID NO: 464, the CDR2 sequence of SEQ ID NO: 466, and the CDR3 sequence of SEQ ID NO: 468.

Another preferred embodiment of the invention relates to an anti-human PCSK9 antibody or antibody fragment wherein the variable heavy chain comprises the CDR1 sequence of SEQ ID NO: 484, the CDR2 sequence of SEQ ID NO: 486, and the CDR3 sequence of SEQ ID NO: 488; and/or the variable light chain comprises the CDR1 sequence of SEQ ID NO: 504, the CDR2 sequence of SEQ ID NO: 506, and the CDR3 sequence of SEQ ID NO: 508.

Another preferred embodiment of the invention relates to an anti-human PCSK9 antibody or antibody fragment wherein the variable heavy chain comprises the CDR1 sequence of SEQ ID NO: 524, the CDR2 sequence of SEQ ID NO: 526, and the CDR3 sequence of SEQ ID NO: 528; and/or the variable light chain comprises the CDR1 sequence of SEQ ID NO: 544, the CDR2 sequence of SEQ ID NO: 546, and the CDR3 sequence of SEQ ID NO: 548.

Another preferred embodiment of the invention relates to an anti-human PCSK9 antibody or antibody fragment, wherein the variable heavy chain comprises the CDR1 sequence of SEQ ID NO: 564, the CDR2 sequence of SEQ ID NO: 566, and the CDR3 sequence of SEQ ID NO: 568; and/or the variable light chain comprises the CDR1 sequence of SEQ ID NO: 584, the CDR2 sequence of SEQ ID NO: 586, and the CDR3 sequence of SEQ ID NO: 588.

Another preferred embodiment of the invention relates to an anti-human PCSK9 antibody or antibody fragment, wherein the variable heavy chain comprises the CDR1 sequence of SEQ ID NO: 604, the CDR2 sequence of SEQ ID NO: 606, and the CDR3 sequence of SEQ ID NO: 608; and/or the variable light chain comprises the CDR1 sequence of SEQ ID NO: 624, the CDR2 sequence of SEQ ID NO: 626, and the CDR3 sequence of SEQ ID NO: 628.

Another preferred embodiment of the invention relates to an anti-human PCSK9 antibody or antibody fragment, wherein the variable heavy chain comprises the CDR1 sequence of SEQ ID NO: 644, the CDR2 sequence of SEQ ID NO: 646, and the CDR3 sequence of SEQ ID NO: 648; and/or the variable light chain comprises the CDR1 sequence of SEQ ID NO: 664, the CDR2 sequence of SEQ ID NO: 666, and the CDR3 sequence of SEQ ID NO: 668.

Another preferred embodiment of the invention relates to an anti-human PCSK9 antibody or antibody fragment, wherein the variable heavy chain comprises the CDR1 sequence of SEQ ID NO: 684, the CDR2 sequence of SEQ ID NO: 686, and the CDR3 sequence of SEQ ID NO: 688; and/or the variable light chain comprises the CDR1 sequence of SEQ ID NO: 704, the CDR2 sequence of SEQ ID NO: 706, and the CDR3 sequence of SEQ ID NO: 708.

Another preferred embodiment of the invention relates to an anti-human PCSK9 antibody or antibody fragment wherein the variable heavy chain comprises the CDR1 sequence of SEQ ID NO: 724, the CDR2 sequence of SEQ ID NO: 726, and the CDR3 sequence of SEQ ID NO: 728; and/or the variable light chain comprises the CDR1 sequence of SEQ ID NO: 744, the CDR2 sequence of SEQ ID NO: 746, and the CDR3 sequence of SEQ ID NO: 748.

Another preferred embodiment of the invention relates to an anti-human PCSK9 antibody or antibody fragment, wherein the variable heavy chain comprises the CDR1 sequence of SEQ ID NO: 764, the CDR2 sequence of SEQ ID NO: 766, and the CDR3 sequence of SEQ ID NO: 768; and/or the variable light chain comprises the CDR1 sequence of SEQ ID NO: 784, the CDR2 sequence of SEQ ID NO: 786, and the CDR3 sequence of SEQ ID NO: 788.

Another preferred embodiment of the invention relates to an anti-human PCSK9 antibody or antibody fragment wherein the variable heavy chain comprises the CDR1 sequence of SEQ ID NO: 804, the CDR2 sequence of SEQ ID NO: 806, and the CDR3 sequence of SEQ ID NO: 808; and/or the variable light chain comprises the CDR1 sequence of SEQ ID NO: 824, the CDR2 sequence of SEQ ID NO: 826, and the CDR3 sequence of SEQ ID NO: 828.

Another preferred embodiment of the invention relates to an anti-human PCSK9 antibody or antibody fragment wherein the variable heavy chain comprises the CDR1 sequence of SEQ ID NO: 844, the CDR2 sequence of SEQ ID NO: 846, and the CDR3 sequence of SEQ ID NO: 848; and/or the variable light chain comprises the CDR1 sequence of SEQ ID NO: 864, the CDR2 sequence of SEQ ID NO: 866, and the CDR3 sequence of SEQ ID NO: 868.

Another preferred embodiment of the invention relates to an anti-human PCSK9 antibody or antibody fragment wherein the variable heavy chain comprises the CDR1 sequence of SEQ ID NO: 884, the CDR2 sequence of SEQ ID NO: 886, and the CDR3 sequence of SEQ ID NO: 888; and/or the variable light chain comprises the CDR1 sequence of SEQ ID NO: 904, the CDR2 sequence of SEQ ID NO: 906, and the CDR3 sequence of SEQ ID NO: 908.

Another preferred embodiment of the invention relates to an anti-human PCSK9 antibody or antibody fragment, wherein the variable heavy chain comprises the CDR1 sequence of SEQ ID NO: 924, the CDR2 sequence of SEQ ID NO: 926, and the CDR3 sequence of SEQ ID NO: 928; and/or the variable light chain comprises the CDR1 sequence of SEQ ID NO: 944, the CDR2 sequence of SEQ ID NO: 946, and the CDR3 sequence of SEQ ID NO: 948.

Another preferred embodiment of the invention relates to an anti-human PCSK9 antibody or antibody fragment, wherein the variable heavy chain comprises a sequence at least 80, 85, 90, 95, 96, 97, 98, 99 or 100% identical to SEQ ID NO: 2 and/or the variable light chain comprises SEQ ID NO: 22.

Another preferred embodiment of the invention relates to an anti-human PCSK9 antibody or antibody fragment, wherein the variable heavy and light chains are each at least 90% identical to the variable heavy and light chains in SEQ ID NO: 2 and SEQ ID NO: 22, respectively.

Another preferred embodiment of the invention relates to an anti-human PCSK9 antibody or antibody fragment wherein the variable heavy chain comprises a sequence at least 80, 85, 90, 95, 96, 97, 98, 99 or 100% identical to SEQ ID NO: 42 and the variable light chain comprises a sequence at least 80, 85, 90, 95, 96, 97, 98, 99 or 100% identical to SEQ ID NO: 62.

Another preferred embodiment of the invention relates to an anti-human PCSK9 antibody or antibody fragment, wherein the variable heavy and light chains are each at least 90% identical to the variable heavy and light chains in SEQ ID NO: 42 and SEQ ID NO: 62, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 82 and the variable light chain comprises a sequence at least 80, 85, 90, 95, 96, 97, 98, 99 or 100% identical to SEQ ID NO: 102.

Another preferred embodiment of the invention relates to an anti-human PCSK9 antibody or antibody fragment wherein the variable heavy and light chains are each at least 90% identical to the variable heavy and light chains in SEQ ID NO: 82 and SEQ ID NO: 102, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 122 and the variable light chain comprises a sequence at least 80, 85, 90, 95, 96, 97, 98, 99 or 100% identical to SEQ ID NO: 142.

Another preferred embodiment of the invention relates to an anti-human PCSK9 antibody or antibody fragment wherein the variable heavy and light chains are each at least 90% identical to the variable heavy and light chains in SEQ ID NO: 122 and SEQ ID NO: 142, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 162 and the variable light chain comprises a sequence at least 80, 85, 90, 95, 96, 97, 98, 99 or 100% identical to SEQ ID NO: 182.

Another preferred embodiment of the invention relates to an anti-human PCSK9 antibody or antibody fragment, wherein the variable heavy and light chains are each at least 90% identical to the variable heavy and light chains in SEQ ID NO: 162 and SEQ ID NO: 182, respectively.

Another preferred embodiment of the invention relates to an anti-human PCSK9 antibody or antibody fragment according to the invention wherein the variable heavy chain comprises a sequence at least 80, 85, 90, 95, 96, 97, 98, 99 or 100% identical to SEQ ID NO: 202 and the variable light chain comprises a sequence at least 80, 85, 90, 95, 96, 97, 98, 99 or 100% identical to SEQ ID NO: 222.

Another preferred embodiment of the invention relates to an anti-human PCSK9 antibody or antibody fragment, wherein the variable heavy and light chains are each at least 90% identical to the variable heavy and light chains in SEQ ID NO: 202 and SEQ ID NO: 222, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 242 and the variable light chain comprises a sequence at least 80, 85, 90, 95, 96, 97, 98, 99 or 100% identical to SEQ ID NO: 262.

Another preferred embodiment of the invention relates to an anti-human PCSK9 antibody or antibody fragment wherein the variable heavy and light chains are each at least 90% identical to the variable heavy and light chains in SEQ ID NO: 242 and SEQ ID NO: 262, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 282 and the variable light chain comprises a sequence at least 80, 85, 90, 95, 96, 97, 98, 99 or 100% identical to SEQ ID NO: 302.

Another preferred embodiment of the invention relates to an anti-human PCSK9 antibody or antibody fragment, wherein the variable heavy and light chains are each at least 90% identical to the variable heavy and light chains in SEQ ID NO: 282 and SEQ ID NO: 302, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 322 and the variable light chain comprises a sequence at least 80, 85, 90, 95, 96, 97, 98, 99 or 100% identical to SEQ ID NO: 342.

Another preferred embodiment of the invention relates to an anti-human PCSK9 antibody or antibody fragment wherein the variable heavy and light chains are each at least 90% identical to the variable heavy and light chains in SEQ ID NO: 322 and SEQ ID NO: 342, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 362 and the variable light chain comprises a sequence at least 80, 85, 90, 95, 96, 97, 98, 99 or 100% identical to SEQ ID NO: 382.

Another preferred embodiment of the invention relates to an anti-human PCSK9 antibody or antibody fragment, wherein the variable heavy and light chains are each at least 90% identical to the variable heavy and light chains in SEQ ID NO: 362 and SEQ ID NO: 382, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 402 and the variable light chain comprises a sequence at least 80, 85, 90, 95, 96, 97, 98, 99 or 100% identical to SEQ ID NO: 422.

Another preferred embodiment of the invention relates to an anti-human PCSK9 antibody or antibody fragment 55, wherein the variable heavy and light chains are each at least 90% identical to the variable heavy and light chains in SEQ ID NO: 402 and SEQ ID NO: 422, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 442 and the variable light chain comprises a sequence at least 80, 85, 90, 95, 96, 97, 98, 99 or 100% identical to SEQ ID NO: 462.

Another preferred embodiment of the invention relates to an anti-human PCSK9 antibody or antibody fragment, wherein the variable heavy and light chains are each at least 90% identical to the variable heavy and light chains in SEQ ID NO: 442 and SEQ ID NO: 462, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 482 and the variable light chain comprises a sequence at least 80, 85, 90, 95, 96, 97, 98, 99 or 100% identical to SEQ ID NO: 502.

Another preferred embodiment of the invention relates to an anti-human PCSK9 antibody or antibody fragment, wherein the variable heavy and light chains are each at least 90% identical to the variable heavy and light chains in SEQ ID NO: 482 and SEQ ID NO: 502, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 522 and the variable light chain comprises a sequence at least 80, 85, 90, 95, 96, 97, 98, 99 or 100% identical to SEQ ID NO: 542.

Another preferred embodiment of the invention relates to an anti-human PCSK9 antibody or antibody fragment, wherein the variable heavy and light chains are each at least 90% identical to the variable heavy and light chains in SEQ ID NO: 522 and SEQ ID NO: 542, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 562 and the variable light chain comprises a sequence at least 80, 85, 90, 95, 96, 97, 98, 99 or 100% identical to SEQ ID NO: 582.

Another preferred embodiment of the invention relates to an anti-human PCSK9 antibody or antibody fragment, wherein the variable heavy and light chains are each at least 90% identical to the variable heavy and light chains in SEQ ID NO: 562 and SEQ ID NO: 582, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 602 and the variable light chain comprises a sequence at least 80, 85, 90, 95, 96, 97, 98, 99 or 100% identical to SEQ ID NO: 622.

Another preferred embodiment of the invention relates to an anti-human PCSK9 antibody or antibody fragment, wherein the variable heavy and light chains are each at least 90% identical to the variable heavy and light chains in SEQ ID NO: 602 and SEQ ID NO: 622, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 642 and the variable light chain comprises a sequence at least 80, 85, 90, 95, 96, 97, 98, 99 or 100% identical to SEQ ID NO: 662.

Another preferred embodiment of the invention relates to an anti-human PCSK9 antibody or antibody fragment, wherein the variable heavy and light chains are each at least 90% identical to the variable heavy and light chains in SEQ ID NO: 642 and SEQ ID NO: 662, respectively.

Another preferred embodiment of the invention relates to an anti-human PCSK9 antibody or antibody fragment according to the invention, wherein the variable heavy chain comprises a sequence at least 80, 85, 90, 95, 96, 97, 98, 99 or 100% identical to SEQ ID NO: 682 and the variable light chain comprises a sequence at least 80, 85, 90, 95, 96, 97, 98, 99 or 100% identical to SEQ ID NO: 702.

Another preferred embodiment of the invention relates to an anti-human PCSK9 antibody or antibody fragment wherein the variable heavy and light chains are each at least 90% identical to the variable heavy and light chains in SEQ ID NO: 682 and SEQ ID NO: 702, respectively Another preferred embodiment of the invention relates to an anti-human PCSK9 antibody or antibody fragment of wherein the variable heavy chain comprises a sequence at least 80, 85, 90, 95, 96, 97, 98, 99 or 100% identical to SEQ ID NO: 722 and the variable light chain comprises a sequence at least 80, 85, 90, 95, 96, 97, 98, 99 or 100% identical to SEQ ID NO: 742.

Another preferred embodiment of the invention relates to an anti-human PCSK9 antibody or antibody fragment wherein the variable heavy and light chains are each at least 90% identical to the variable heavy and light chains in SEQ ID NO: 722 and SEQ ID NO: 742, respectively Another preferred embodiment of the invention relates to an anti-human PCSK9 antibody or antibody fragment of wherein the variable heavy chain comprises a sequence at least 80, 85, 90, 95, 96, 97, 98, 99 or 100% identical to SEQ ID NO: 762 and the variable light chain comprises a sequence at least 80, 85, 90, 95, 96, 97, 98, 99 or 100% identical to SEQ ID NO: 782.

Another preferred embodiment of the invention relates to an anti-human PCSK9 antibody or antibody fragment wherein the variable heavy and light chains are each at least 90% identical to the variable heavy and light chains in SEQ ID NO: 762 and SEQ ID NO: 782, respectively.

Another preferred embodiment of the invention relates to an anti-human PCSK9 antibody or antibody fragment wherein the variable heavy chain comprises a sequence at least 80, 85, 90, 95, 96, 97, 98, 99 or 100% identical to SEQ ID NO: 802 and the variable light chain comprises a sequence at least 80, 85, 90, 95, 96, 97, 98, 99 or 100% identical to SEQ ID NO: 822.

Another preferred embodiment of the invention relates to an anti-human PCSK9 antibody or antibody fragment, wherein the variable heavy and light chains are each at least 90% identical to the variable heavy and light chains in SEQ ID NO: 802 and SEQ ID NO: 822, respectively.

Another preferred embodiment of the invention relates to an anti-human PCSK9 antibody or antibody fragment of wherein the variable heavy chain comprises a sequence at least 80, 85, 90, 95, 96, 97, 98, 99 or 100% identical to SEQ ID NO: 842 and the variable light chain comprises a sequence at least 80, 85, 90, 95, 96, 97, 98, 99 or 100% identical to SEQ ID NO: 862.

Another preferred embodiment of the invention relates to an anti-human PCSK9 antibody or antibody fragment, wherein the variable heavy and light chains are each at least 90% identical to the variable heavy and light chains in SEQ ID NO: 842 and SEQ ID NO: 862, respectively.

Another preferred embodiment of the invention relates to an anti-human PCSK9 antibody or antibody fragment of wherein the variable heavy chain comprises a sequence at least 80, 85, 90, 95, 96, 97, 98, 99 or 100% identical to SEQ ID NO: 882 and the variable light chain comprises a sequence at least 80, 85, 90, 95, 96, 97, 98, 99 or 100% identical to SEQ ID NO: 902.

Another preferred embodiment of the invention relates to an anti-human PCSK9 antibody or antibody fragment wherein the variable heavy and light chains are each at least 90% identical to the variable heavy and light chains in SEQ ID NO: 882 and SEQ ID NO: 902, respectively.

Another preferred embodiment of the invention relates to an anti-human PCSK9 antibody or antibody fragment of, wherein the variable heavy chain comprises a sequence at least 80, 85, 90, 95, 96, 97, 98, 99 or 100% identical to SEQ ID NO: 922 and the variable light chain comprises a sequence at least 80, 85, 90, 95, 96, 97, 98, 99 or 100% identical to SEQ ID NO: 942.

Another preferred embodiment of the invention relates to an anti-human PCSK9 antibody or antibody fragment wherein the variable heavy and light chains are each at least 90% identical to the variable heavy and light chains in SEQ ID NO: 922 and SEQ ID NO: 942, respectively.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 1 and the light chain comprises a sequence at least 80, 85, 90, 95, 96, 97, 98, 99 or 100% identical to SEQ ID NO: 21.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 41 and the light chain comprises a sequence at least 80, 85, 90, 95, 96, 97, 98, 99 or 100% identical to SEQ ID NO: 61.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 81 and the light chain comprises a sequence at least 80, 85, 90, 95, 96, 97, 98, 99 or 100% identical to SEQ ID NO: 101.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 121 and the light chain comprises a sequence at least 80, 85, 90, 95, 96, 97, 98, 99 or 100% identical to SEQ ID NO: 141.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 161 and the light chain comprises a sequence at least 80, 85, 90, 95, 96, 97, 98, 99 or 100% identical to SEQ ID NO: 181.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 201 and the light chain comprises a sequence at least 80, 85, 90, 95, 96, 97, 98, 99 or 100% identical to SEQ ID NO: 221.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 241 and the light chain comprises a sequence at least 80, 85, 90, 95, 96, 97, 98, 99 or 100% identical to SEQ ID NO: 261.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 281 and the light chain comprises SEQ ID NO: 301.

Another preferred embodiment of the invention relates to an anti-human PCSK9 antibody or antibody fragment, wherein the heavy chain comprises SEQ ID NO: 321 and the light chain comprises a sequence at least 80, 85, 90, 95, 96, 97, 98, 99 or 100% identical to SEQ ID NO: 341.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 361 and the light chain comprises SEQ ID NO: 381.

Another preferred embodiment of the invention relates to an anti-human PCSK9 antibody or antibody fragment, wherein the heavy chain comprises SEQ ID NO: 401 and the light chain comprises a sequence at least 80, 85, 90, 95, 96, 97, 98, 99 or 100% identical to SEQ ID NO: 421.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 441 and the light chain comprises a sequence at least 80, 85, 90, 95, 96, 97, 98, 99 or 100% identical to SEQ ID NO: 461.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 481 and the light chain comprises a sequence at least 80, 85, 90, 95, 96, 97, 98, 99 or 100% identical to SEQ ID NO: 501.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 521 and the light chain comprises SEQ ID NO: 541.

Another preferred embodiment of the invention relates to an anti-human PCSK9 antibody or antibody fragment wherein the heavy chain comprises SEQ ID NO: 561 and the light chain comprises a sequence at least 80, 85, 90, 95, 96, 97, 98, 99 or 100% identical to SEQ ID NO: 581.

Another preferred embodiment of the invention relates to an anti-human PCSK9 antibody or antibody fragment wherein the heavy chain comprises a sequence at least 80, 85, 90, 95, 96, 97, 98, 99 or 100% identical to SEQ ID NO: 601 and the light chain comprises SEQ ID NO: 621.

Another preferred embodiment of the invention relates to an anti-human PCSK9 antibody or antibody fragment, wherein the heavy chain comprises SEQ ID NO: 641 and the light chain comprises a sequence at least 80, 85, 90, 95, 96, 97, 98, 99 or 100% identical to SEQ ID NO: 661.

Another preferred embodiment of the invention relates to an anti-human PCSK9 antibody or antibody fragment of wherein the heavy chain comprises a sequence at least 80, 85, 90, 95, 96, 97, 98, 99 or 100% identical to SEQ ID NO: 681 and the light chain comprises a sequence at least 80, 85, 90, 95, 96, 97, 98, 99 or 100% identical to SEQ ID NO: 701.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 721 and the light chain comprises SEQ ID NO: 741.

Another preferred embodiment of the invention relates to an anti-human PCSK9 antibody or antibody fragment, wherein the heavy chain comprises SEQ ID NO: 761 and the light chain comprises a sequence at least 80, 85, 90, 95, 96, 97, 98, 99 or 100% identical to SEQ ID NO: 781.

Another preferred embodiment of the invention relates to an anti-human PCSK9 antibody or antibody fragment of wherein the heavy chain comprises a sequence at least 80, 85, 90, 95, 96, 97, 98, 99 or 100% identical to SEQ ID NO: 801 and the light chain comprises a sequence at least 80, 85, 90, 95, 96, 97, 98, 99 or 100% identical to SEQ ID NO: 821.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 841 and the light chain comprises a sequence at least 80, 85, 90, 95, 96, 97, 98, 99 or 100% identical to SEQ ID NO: 861.

Another preferred embodiment of the invention relates to an anti-human PCSK9 antibody or antibody fragment, wherein the heavy chain comprises a sequence at least 80, 85, 90, 95, 96, 97, 98, 99 or 100% identical to SEQ ID NO: 881 and the light chain comprises SEQ ID NO: 901.

Another preferred embodiment of the invention relates to an anti-human PCSK9 antibody or antibody fragment, wherein the heavy chain comprises SEQ ID NO: 921 and the light chain comprises a sequence at least 80, 85, 90, 95, 96, 97, 98, 99 or 100% identical to SEQ ID NO: 941.

Another preferred embodiment of the invention relates to an anti-human PCSK9 antibody or antibody fragment wherein the antibody or antibody fragment is selected from the group consisting of chimeric, humanized, and human antibodies or antibody fragments.

Another preferred embodiment of the invention relates to an anti-human PCSK9 antibody or antibody fragment, wherein the antibody or antibody fragment is selected from the group consisting of scFvs, camelbodies, nanobodies, IgNAR, $F_{ab}$ fragments, $F_{ab'}$ fragments, MetMab like antibodies, monovalent antibody fragments, and $F_{(ab')2}$ fragments.

Another preferred embodiment of the invention relates to an anti-human PCSK9 antibody or antibody fragment, wherein the antibody or antibody fragment substantially or entirely lacks N-glycosylation and/or O-glycosylation.

Another preferred embodiment of the invention relates to an anti-human PCSK9 antibody or antibody fragment, wherein the antibody or antibody fragment comprises a human constant domain.

Another preferred embodiment of the invention relates to an anti-human PCSK9 antibody or antibody fragment, wherein the antibody is an IgG1, IgG2, IgG3, or IgG4 antibody.

Another preferred embodiment of the invention relates to an anti-human PCSK9 antibody or antibody fragment, wherein the antibody or antibody fragment comprises an Fc region that has been modified to alter at least one of effector function, half-life, proteolysis, or glycosylation.

Another preferred embodiment of the invention relates to an anti-human PCSK9 antibody or antibody fragment, wherein the Fc region contains one or more mutations that alter or eliminate N- and/or O-glycosylation.

Another preferred embodiment of the invention relates to an anti-human PCSK9 antibody or antibody fragment, wherein the antibody or antibody fragment is a humanized antibody or antibody fragment.

Another preferred embodiment of the invention relates to an anti-human PCSK9 antibody or antibody fragment wherein the antibody or antibody fragment binds to PCSK9 with a dissociation constant ($K_d$) of less than or equal to $10^{-2}$ M, $5 \times 10^{-3}$ M, $10^{-3}$ M, $5 \times 10^{-4}$ M, $10^{-4}$ M, $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M.

Another preferred embodiment of the invention relates to an anti-human PCSK9 antibody or antibody fragment, wherein the antibody or antibody fragment binds to PCSK9 with a dissociation constant ($K_d$) of less than or equal to $10^{-11}$ M, $5 \times 10^{-12}$ M, or $10^{-12}$ M.

Another preferred embodiment of the invention relates to an anti-human PCSK9 antibody or antibody fragment, which binds to PCSK9 with an off-rate of less than or equal to $10^{-4}$ $S^{-1}$, $5 \times 10^{-5}$ $S^{-1}$, $10^{-5}$ $S^{-1}$, $5 \times 10^{-6}$ $S^{-1}$, $10^{-6}$ $S^{-1}$, $5 \times 10^{-7}$ $S^{-1}$, or $10^{-7}$ $S^{-1}$.

Another preferred embodiment of the invention relates to an anti-human PCSK9 antibody or antibody fragment, wherein the antibody or antibody fragment is directly or indirectly attached to a detectable label or therapeutic agent.

Another preferred embodiment of the invention relates to an anti-human PCSK9 antibody or antibody fragment, which when administered to a human subject inhibits or neutralizes at least one biological effect elicited by PCSK9.

Another preferred embodiment of the invention relates to an anti-human PCSK9 antibody or antibody fragment which when administered to a human subject reduces serum cholesterol.

Another preferred embodiment of the invention relates to an anti-human PCSK9 antibody or antibody fragment, wherein the antibody or antibody fragment is capable of inhibiting the binding of PCSK9 to LDLR.

Another preferred embodiment of the invention relates to an anti-human PCSK9 antibody or antibody fragment, wherein the antibody or antibody fragment binds to PCSK9 with a $K_D$ that is less than about 100 nM.

Another preferred embodiment of the invention relates to an anti-human PCSK9 antibody or antibody fragment, wherein the antibody or antibody fragment binds to PCSK9 with a $K_D$ that is less than about 10 nM.

Another preferred embodiment of the invention relates to an anti-human PCSK9 antibody or antibody fragment, wherein the antibody or antibody fragment binds to PCSK9 with a $K_D$ that is less than about 1 nM.

Another preferred embodiment of the invention relates to an anti-human PCSK9 antibody or antibody fragment, wherein the antibody or antibody fragment binds to PCSK9 with a $K_D$ that is between about 1 and about 10 nM.

Another preferred embodiment of the invention relates to an anti-human PCSK9 antibody or antibody fragment, wherein the antibody or antibody fragment binds to PCSK9 with a $K_D$ that is between about 0.1 and about 1 nM.

Another preferred embodiment of the invention relates to an anti-human PCSK9 antibody or antibody fragment, wherein the antibody or antibody fragment binds to PCSK9 with a $K_D$ that is between 0.12 and 7.99 nM.

Another preferred embodiment of the invention relates to an anti-human PCSK9 antibody or antibody fragment, wherein the antibody or antibody fragment is attached to at least one effector moiety.

Another preferred embodiment of the invention relates to an anti-human PCSK9 antibody or antibody fragment, wherein effector moiety comprises a chemical linker.

Another preferred embodiment of the invention relates to an anti-human PCSK9 antibody or antibody fragment, wherein the antibody or antibody fragment is attached to one or more detectable moieties.

Another preferred embodiment of the invention relates to an anti-human PCSK9 antibody or antibody fragment, wherein detectable moiety comprises a fluorescent dye, enzyme, substrate, bioluminescent material, radioactive material, chemiluminescent moiety, or mixtures thereof.

Another preferred embodiment of the invention relates to an anti-human PCSK9 antibody or antibody fragment wherein the antibody or antibody fragment is attached to one or more functional moieties.

An anti-idiotypic antibody produced against an anti-human PCSK9 antibody or antibody fragment according to the invention.

A composition suitable for therapeutic, prophylaxis, or a diagnostic use comprising a therapeutically, prophylactically or diagnostically effective amount of at least one antibody or antibody fragment according to the invention.

Another preferred embodiment of the invention relates to an composition, which is suitable for subcutaneous administration containing at least one antibody or antibody fragment according to the invention.

Another preferred embodiment of the invention relates to an composition which is suitable for intravenous administration containing at least one antibody or antibody fragment according to the invention.

Another preferred embodiment of the invention relates to a composition, which is suitable for topical administration containing at least one antibody or antibody fragment according to the invention.

Another preferred embodiment of the invention relates to a composition, which is lyophilized containing at least one antibody or antibody fragment according to the invention.

Another preferred embodiment of the invention relates to a composition containing at least one antibody or antibody fragment according to the invention further comprising a pharmaceutically acceptable diluent, carrier, solubilizer, emulsifier, preservative, or mixture thereof.

Another preferred embodiment of the invention relates to a composition containing at least one antibody or antibody fragment according to the invention, further comprising another active agent.

Another preferred embodiment of the invention relates to an composition containing at least one antibody or antibody fragment according to the invention, wherein the other active agent is selected from the group consisting of the following: statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, pantethine, anti-hypertensives, antidiabetigenic drugs, Meglitinides, Sulfonylurea, and Thiazolidinediones.

Another preferred embodiment of the invention relates to an composition containing at least one antibody or antibody fragment according to the invention, wherein the ACE inhibitor is selected from: Capoten (captopril), Vasotec (enalapril), Prinivil, Zestril (lisinopril), Lotensin (benazepril), Monopril (fosinopril), Altace (ramipril), Accupril (quinapril), Aceon (perindopril), Mavik (trandolapril), Univasc (moexipril), Another preferred embodiment of the invention relates to a composition containing at least one antibody or antibody fragment according to the invention, wherein the ARB is selected from: Cozaar (losartan), Diovan (valsartan), Avapro (irbesartan), Atacand (candesartan), and Micardis (telmisartan).

Another preferred embodiment of the invention relates to an composition containing at least one antibody or antibody fragment according to the invention, wherein the Antiarrhythmic is selected from Tambocor (flecamide), Procanbid (procainamide), Cordarone (amiodarone), and Betapace (sotalol).

Another preferred embodiment of the invention relates to an composition containing at least one antibody or antibody fragment according to the invention, wherein the anticlotting agent is selected from Anticlotting agents which may be used in combination with the subject anti-PCSK9 antibodies and antibody fragments include: Tissue plasminogen activator (TPA), Tenecteplase, Alteplase, Urokinase, Reteplase, and Streptokinase.

Another preferred embodiment of the invention relates to an composition containing at least one antibody or antibody fragment according to the invention wherein the Beta blocker is selected from Sectral (acebutolol), Zebeta (bisoprolol), Brevibloc (esmolol), Inderal (propranolol), Tenormin (atenolol), Normodyne, Trandate (labetalol), Coreg (carvedilol), Lopressor, and Toprol-XL (metoprolol).

Another preferred embodiment of the invention relates to an composition containing at least one antibody or antibody fragment according to the invention, wherein the calcium channel blocker is selected from: Norvasc (amlodipine), Plendil (felodipine), Cardizem, Cardizem CD, Cardizem SR, Dilacor XR, Diltia XT, Tiazac (diltiazem), Calan, Calan SR, Covera-HS, Isoptin, Isoptin SR, Verelan, Verelan PM (verapamil), Adalat, Adalat CC, Procardia, Procardia XL (nifedipine), Cardene, Cardene SR (nicardipine), Sular (nisoldipine), Vascor (bepridil), and Caduet which is a combination of a statin cholesterol drug and amlodipine.

Another preferred embodiment of the invention relates to an composition containing at least one antibody or antibody fragment according to the invention, wherein the diuretic is selected from: Lasix (furosemide), Bumex (bumetanide), Demadex (torsemide), Esidrix (hydrochlorothiazide), Zaroxolyn (metolazone), and Aldactone (spironolactone).

Another preferred embodiment of the invention relates to an composition containing at least one antibody or antibody fragment according to the invention, wherein the heart failure drug is selected from Dobutrex (dobutamine), and Primacor (milrinone).

Another preferred embodiment of the invention relates to an composition containing an antibody or fragment according to the invention, wherein the vasodilator is selected from Dilatrate-SR, Iso-Bid, Isonate, Isorbid, Isordil, Isotrate, Sorbitrate (isosorbide dinitrate), IMDUR (isorbide mononitrate), and BiDil (hydralazine with isosorbide dinitrate.

Another preferred embodiment of the invention relates to an composition containing at least one antibody or antibody fragment according to the invention, wherein the blood thinner is selected Warfarin (coumadin), Heparin, Lovenox, and Fragmin.

Another preferred embodiment of the invention relates to an composition of containing an antibody according to the invention wherein the composition further comprises another therapeutic agent that elevates the availability of LDLR protein.

Another preferred embodiment of the invention relates to an composition containing at least one antibody or antibody fragment according to the invention, wherein the composition further comprises another therapeutic agent that blocks or inhibits cholesterol synthesis.

Another preferred embodiment of the invention relates to an composition containing at least one antibody or antibody fragment according to the invention, wherein the composition further comprises a statin.

Another preferred embodiment of the invention relates to an composition containing at least one antibody or antibody fragment according to the invention, wherein the statin is selected atorvastatin, cerivastatin, fluvastatin, lovastatin, mevastatin, pitavastatin, pravastatin, rosuvastatin, simvastatin, or mixtures thereof.

Another preferred embodiment of the invention relates to an composition containing at least one antibody or antibody fragment according to the invention, wherein the composition further comprises another therapeutic agent that elevates the HDL level, or an agent which decreases triglyceride levels, or both.

Another preferred embodiment of the invention relates to an composition containing at least one antibody or antibody fragment according to the invention, wherein the composition further comprises a fibrate.

Another preferred embodiment of the invention relates to an composition containing at least one antibody or antibody fragment according to the invention, wherein the fibrate comprises bezafibrate, ciprofibrate, clofibrate, gemfibrozil, fenofibrate, or mixtures thereof.

Another preferred embodiment of the invention relates to an composition containing at least one antibody or antibody fragment according to the invention, wherein the composition further comprises a bile sequestering agent.

Another preferred embodiment of the invention relates to an composition containing at least one antibody or antibody fragment according to the invention, wherein bile sequestering agent comprises cholestyramine, colesevelam, colestipol, or mixtures thereof.

Another preferred embodiment of the invention relates to an composition containing at least one antibody or antibody fragment according to the invention, wherein the composition further comprises an agent that decreases cholesterol absorption in the intestines.

Another preferred embodiment of the invention relates to an composition containing at least one antibody or antibody fragment according to the invention, wherein the agent comprises ezetimibe.

Another preferred embodiment of the invention relates to an composition containing at least one antibody or antibody fragment according to the invention, wherein the composition comprises an agent that that inhibits hepatic triglyceride production, inhibits VLDL secretions, or both.

Another preferred embodiment of the invention relates to an composition containing at least one antibody or antibody fragment according to the invention wherein the agent comprises acipimox.

Another preferred embodiment of the invention relates to an composition containing at least one antibody or antibody fragment according to the invention, wherein the composition further comprises an agent that decreases lipid absorption in the intestines.

Another preferred embodiment of the invention relates to an composition containing an antibody according to the invention, wherein the agent comprises orlistat, lipstatin, or mixtures thereof.

Another preferred embodiment of the invention relates to an composition containing at least one antibody or antibody fragment according to the invention, wherein the composition further comprises an agent that is an anti-hypertensive, an agent that treats angina, or both.

Another preferred embodiment of the invention relates to an composition containing at least one antibody or antibody fragment according to the invention, wherein said anti-hypertensive or anti-angina agent is selected from a diuretic, an adrenergic receptor antagonist, a calcium channel blocker, a renin inhibitor, an ACE inhibitor, an angiotensin II receptor antagonist, aa aldosterone antagonist, a vasodilator or an alpha-2 agonist.

Another preferred embodiment of the invention relates to an composition containing at least one antibody or antibody fragment according to the invention, wherein the diuretics include bumetanide, thacrynic acid, furosemide, and torsemide; a thiazide diuretic such as epitizide, hydrochlorothiazide or chlorothiazide, or bendroflumethiazide; a thiazide-like diuretic such as indapamide, chlorthalidone, or metolazone; a potassium-sparing diuretic such as amiloride, triamterene, or spironolactone; the adrenergic receptor antagonists include beta blockers such as atenolol, metoprolol, nadolol, oxprenolol, pindolol, propranolol, or timolol; the alpha blockers include doxazosin, phentolamine, indoramin, phenoxybenzamine, prazosin, terazosin, and tolazoline; mixed alpha+beta blockers such as bucindolol, carvedilol, and labetalol; the calcium channel blockers include dihydropyridines such as amlodipine, felodipine, isradipine, lercanidipine, nicardipine, nifedipine, nimodipine, and nitrendipine; non-dihydropyridines such as diltiazem and verapamil; renin inhibitors such as Aliskiren; ACE inhibitors such as captopril, enalapril, fosinopril, lisinopril, perindopril, quinapril, ramipril, trandolapril, and benazepril; angiotensin II receptor antagonists such as candesartan, eprosartan, irbesartan, losartan, olmesartan, telmisartan, and valsartan; aldosterone antagonists such as eplerenone and spironolactone; vasodilators such as sodium nitroprusside; and Alpha-2 agonists such as Clonidine, Guanabenz, Methyldopa, Moxonidine, Guanethidine or Reserpine; or a nitrate such as nitroglycerin (glyceryl trinitrate), pentaerythritol tetranitrate, isosorbide dinitrate or isosorbide mononitrate.

Another preferred embodiment of the invention relates to an composition containing at least one antibody or antibody fragment according to the invention, which further comprises at least one other agent, wherein the combination allows for mitigation of undesirable side effects of at least one other agent contained therein.

Another preferred embodiment of the invention relates to an composition containing at least one antibody or antibody fragment according to the invention which further comprises at least one therapeutic agent for inflammation.

Another preferred embodiment of the invention relates to an composition containing at least one antibody or antibody fragment according to the invention, wherein the therapeutic agent for inflammation comprises a cyclooxygenase type 1 inhibitor, a cyclooxygenase type 2 inhibitor, a small molecule modulator of p38-MAPK, a small molecule modulator of intracellular molecules involved in inflammation pathways, or mixtures thereof.

Another preferred embodiment of the invention relates to an composition containing at least one antibody or antibody fragment according to the invention, which is lyophilized, stabilized and/or or formulated for administration by injection.

Another preferred embodiment of the invention relates to a method for blocking, inhibiting or neutralizing one or more biological effects associated with PCSK9 comprising administering to a subject in need thereof an effective amount of at least one antibody or composition according to the invention.

Another preferred embodiment of the invention relates to method for treating or preventing a condition associated with elevated serum cholesterol levels in a patient, comprising administering to a patient in need thereof an effective amount of at least one antibody according to the invention or a composition containing optionally with another active agent.

Another preferred embodiment of the invention relates to method for treating or preventing elevated serum cholesterol levels in a patient in need thereof or at risk of developing elevated serum cholesterol levels because of an existing condition, comprising administering to the patient an effective amount of at least one antibody according to an effective amount of at least one antibody according to the invention or a composition containing optionally with another active agent.

Another preferred embodiment of the invention relates to a method wherein the condition treated is selected from the group consisting of hypercholesterolemia, coronary heart disease, hyperlipidemia, hypertriglyceridaemia, sitosterolemia, atherosclerosis, arteriosclerosis metabolic syndrome, acute coronary syndrome, vascular inflammation, xanthoma, diabetes, obesity, hypertension, and angina.

Another preferred embodiment is a method for treating or preventing a disorder involving cholesterol or lipid homeostasis or complications associated therewith, comprising administering to the patient an effective amount of at least one antibody according to an effective amount of at least one antibody according to the invention or a composition containing optionally with another active agent.

Another preferred embodiment of the invention relates to a method of treatment wherein the treated condition is selected from hypercholesterolemia, hyperlipidemia, hypertriglyceridaemia, and sitosterolemia using an effective amount of at least one antibody according to the invention or a composition containing optionally with another active agent.

Another preferred embodiment of the invention relates to a method using an effective amount of at least one antibody according to the invention or a composition containing optionally with another active agent, wherein the at least one isolated anti-human PCSK9 antibody or antibody inhibits the binding of PCSK9 to LDLR.

Another preferred embodiment of the invention relates to a method using an effective amount of at least one antibody according to the invention or a composition containing optionally with another active agent, wherein the at least one isolated anti-human PCSK9 antibody or antibody fragment results in blocking or inhibition of cholesterol synthesis.

Another preferred embodiment of the invention relates to a method using an effective amount of at least one antibody according to the invention or a composition containing optionally with another active agent, wherein the method further comprises administering separately or co-administering another agent, which agent that elevates the availability of LDLR protein or which blocks or inhibits cholesterol synthesis.

Another preferred embodiment of the invention relates to a method using an effective amount of at least one antibody according to the invention or a composition containing optionally with another active agent, wherein the administration is part of a therapeutic regimen that further includes the administration of at least one of the following: statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, pantethine, anti-hypertensives, antidiabetigenic drugs, Meglitinides, Sulfonylurea, and Thiazolidinediones.

Another preferred embodiment of the invention relates to a method using an effective amount of at least one antibody according to the invention or a composition containing optionally with another active agent, wherein the ACE inhibitor is selected from: Capoten (captopril), Vasotec (enalapril), Prinivil, Zestril (lisinopril), Lotensin (benazepril), Monopril (fosinopril), Altace (ramipril), Accupril (quinapril), Aceon (perindopril), Mavik (trandolapril), Univasc (moexipril), Another preferred embodiment of the invention relates to a method using an effective amount of at least one antibody according to the invention or a composition containing optionally with another active agent wherein the ARB is selected from: Cozaar (losartan), Diovan (valsartan), Avapro (irbesartan), Atacand (candesartan), and Micardis (telmisartan).

Another preferred embodiment of the invention relates to a method using an effective amount of at least one antibody according to the invention or a composition containing optionally with another active agent wherein the antiarythmic is selected from: Tambocor (flecamide), Procanbid (procainamide), Cordarone (amiodarone), and Betapace (sotalol).

Another preferred embodiment of the invention relates to a method using an effective amount of at least one antibody according to the invention or a composition containing optionally with another active agent, wherein the anti-clotting agent is selected from: Tissue plasminogen activator (TPA), Tenecteplase, Alteplase, Urokinase, Reteplase, and Streptokinase.

Another preferred embodiment of the invention relates to a method using an effective amount of at least one antibody according to the invention or a composition containing optionally with another active agent wherein the Beta-blocker is selected from: Sectral (acebutolol), Zebeta (bisoprolol), Brevibloc (esmolol), Inderal (propranolol), Tenormin (atenolol), Normodyne, Trandate (labetalol), Coreg (carvedilol), Lopressor, and Toprol-XL (metoprolol).

Another preferred embodiment of the invention relates to a method using an effective amount of at least one antibody according to the invention or a composition containing optionally with another active agent, wherein the calcium channel blocker is selected from: Norvasc (amlodipine), Plendil (felodipine), Cardizem, Cardizem CD, Cardizem SR, Dilacor XR, Diltia XT, Tiazac (diltiazem), Calan, Calan SR, Covera-HS, Isoptin, Isoptin SR, Verelan, Verelan PM (verapamil), Adalat, Adalat CC, Procardia, Procardia XL (nifedipine), Cardene, Cardene SR (nicardipine), Sular (nisoldipine), Vascor (bepridil), and Caduet which is a combination of a statin cholesterol drug and amlodipine.

Another preferred embodiment of the invention relates to a method using an effective amount of at least one antibody according to the invention or a composition containing optionally with another active agent wherein the antidiuretic is selected from: Lasix (furosemide), Bumex (bumetanide), Demadex (torsemide), Esidrix (hydrochlorothiazide), Zaroxolyn (metolazone), and Aldactone (spironolactone).

Another preferred embodiment of the invention relates to a method using an effective amount of at least one antibody according to the invention or a composition containing optionally with another active agent, wherein the heart failure drug is selected from Dobutrex (dobutamine), and Primacor (milrinone).

Another preferred embodiment of the invention relates to a method using an effective amount of at least one antibody according to the invention or a composition containing optionally with another active agent, wherein the vasodilator is selected from: Dilatrate-SR, Iso-Bid, Isonate, Isorbid, Isordil, Isotrate, Sorbitrate (isosorbide dinitrate), IMDUR (isorbide mononitrate), and BiDil (hydralazine with isosorbide dinitrate.

Another preferred embodiment of the invention relates to a method containing an antibody according to the invention, wherein the blood thinner is selected from Warfarin (coumadin), Heparin, Lovenox, and Fragmin.

Another preferred embodiment of the invention relates to a method using an effective amount of at least one antibody according to the invention or a composition containing optionally with another active agent, wherein the agent that elevates the availability of LDLR protein or which blocks or inhibits cholesterol synthesis is administered simultaneously with the antibody or composition containing.

Another preferred embodiment of the invention relates to a method using an effective amount of at least one antibody according to the invention or a composition containing optionally with another active agent, wherein another agent that elevates the availability of LDLR protein or which blocks or inhibits cholesterol synthesis is administered. sequentially relative to the administration of the antibody or composition containing.

Another preferred embodiment of the invention relates to a method using an effective amount of at least one antibody according to the invention or a composition containing optionally with another active agent, wherein the agent that blocks or inhibits cholesterol synthesis protein comprises a statin.

Another preferred embodiment of the invention relates to a method using an effective amount of at least one antibody according to the invention or a composition containing optionally with another active agent, wherein the statin is selected from atorvastatin, cerivastatin, fluvastatin, lovastatin, mevastatin, pitavastatin, pravastatin, rosuvastatin, simvastatin, or mixtures thereof.

Another preferred embodiment of the invention relates to a method using an effective amount of at least one antibody according to the invention or a composition containing optionally with another active agent wherein the method further comprises administering an agent that elevates the HDL level, an agent that decreases triglyceride levels, or both.

Another preferred embodiment of the invention relates to a method using an effective amount of at least one antibody according to the invention or a composition containing optionally with another active agent, wherein the agent comprises a fibrate.

Another preferred embodiment of the invention relates to a method using an effective amount of at least one antibody according to the invention or a composition containing optionally with another active agent, wherein the fibrate agent comprises bezafibrate, ciprofibrate, clofibrate, gemfibrozil, fenofibrate, or mixtures thereof.

Another preferred embodiment of the invention relates to a method using an effective amount of at least one antibody according to the invention or a composition containing optionally with another active agent, wherein the method further comprises administering a bile sequestering agent.

Another preferred embodiment of the invention relates to a method using an effective amount of at least one antibody according to the invention or a composition containing optionally with another active agent, wherein the bile sequestering agent comprises cholestyramine, colesevelam, colestipol, or mixtures thereof.

Another preferred embodiment of the invention relates to a method using an effective amount of at least one antibody according to the invention or a composition containing optionally with another active agent, wherein the method further comprises administering an agent that decreases cholesterol absorption in the intestines.

Another preferred embodiment of the invention relates to a method using an effective amount of at least one antibody according to the invention or a composition containing optionally with another active agent, wherein the agent comprises ezetimibe.

Another preferred embodiment of the invention relates to a method using an effective amount of at least one antibody according to the invention or a composition containing optionally with another active agent 174, wherein the method further comprises administering an agent that inhibits hepatic triglyceride production, inhibits VLDL secretions, or both.

Another preferred embodiment of the invention relates to a method using an effective amount of at least one antibody according to the invention or a composition containing optionally with another active agent, wherein the agent comprises acipimox.

Another preferred embodiment of the invention relates to a method using an effective amount of at least one antibody according to the invention or a composition containing optionally with another active agent, wherein the method further comprises administering an agent that decreases lipid absorption in the intestines.

Another preferred embodiment of the invention relates to a method using an effective amount of at least one antibody according to the invention or a composition containing optionally with another active agent, wherein the agent comprises orlistat, lipstatin, or mixtures thereof.

Another preferred embodiment of the invention relates to a method using an effective amount of at least one antibody according to the invention or a composition containing optionally with another active agent 174, wherein the method further comprises administering an agent that is an anti-hypertensive, one that treats angina, or both.

Another preferred embodiment of the invention relates to a method using an effective amount of at least one antibody according to the invention or a composition containing optionally with another active agent, wherein said anti-hypertensive or anti-angina agent is selected from a diuretic, an adrenergic receptor antagonist, a calcium channel blocker, a renin inhibitor, an ACE inhibitor, an angiotensin II receptor antagonist, aa aldosterone antagonist, a vasodilator or an alpha-2 agonist.

Another preferred embodiment of the invention relates to a method using an effective amount of at least one antibody according to the invention or a composition containing optionally with another active agent, wherein the diuretics include bumetanide, thacrynic acid, furosemide, and torsemide; a thiazide diuretic such as epitizide, hydrochlorothiazide or chlorothiazide, or bendroflumethiazide; a thiazide-like diuretic such as indapamide, chlorthalidone, or metolazone; a potassium-sparing diuretic such as amiloride, triamterene, or spironolactone; the adrenergic receptor antagonists include beta blockers such as atenolol, metoprolol, nadolol, oxprenolol, pindolol, propranolol, or timolol; the alpha blockers include doxazosin, phentolamine, indoramin, phenoxybenzamine, prazosin, terazosin, and tolazoline; mixed alpha+beta blockers such as bucindolol, carvedilol, and labetalol; the calcium channel blockers include dihydropyridines such as amlodipine, felodipine, isradipine, lercanidipine, nicardipine, nifedipine, nimodipine, and nitrendipine; non-dihydropyridines such as diltiazem and verapamil; renin inhibitors such as Aliskiren; an ACE inhibitors such as captopril, enalapril, fosinopril, lisinopril, perindopril, quinapril, ramipril, trandolapril, and benazepril; angiotensin II receptor antagonists such as candesartan, eprosartan, irbesartan, losartan, olmesartan, telmisartan, and valsartan; aldosterone antagonists such as eplerenone and spironolactone; vasodilators such as sodium nitroprusside; and Alpha-2 agonists such as Clonidine, Guanabenz, Methyldopa, Moxonidine, Guanethidine or Reserpine; or a nitrate such as nitroglycerin (glyceryl trinitrate), pentaerythritol tetranitrate, isosorbide dinitrate or isosorbide mononitrate.

Another preferred embodiment of the invention relates to a method using an effective amount of at least one antibody according to the invention or a composition containing optionally with another active agent, wherein the method further comprises administering at least one other agent, wherein the combination allows for mitigation of undesirable side effects of at least one other agent.

Another preferred embodiment of the invention relates to a method using an effective amount of at least one antibody according to the invention or a composition containing optionally with another active agent, wherein the antibody or antibody fragment or composition containing and the at least one other agent are administered concurrently.

Another preferred embodiment of the invention relates to a method using an effective amount of at least one antibody according to the invention or a composition containing optionally with another active agent, wherein the antibody or antibody fragment is administered before or after the at least one other agent.

A method for lowering serum cholesterol level in a subject comprising administering to a subject an effective amount of at least one anti-human PCSK9 antibody or antibody fragment according to the invention or a composition containing.

Another preferred embodiment of the invention relates to a method using an effective amount of at least one antibody according to the invention or a composition containing optionally with another active agent, wherein administering the at least one isolated anti-human PCSK9 antibody or antibody fragment or composition inhibits PCSK9 binding to LDLR.

Another preferred embodiment of the invention relates to a method using an effective amount of at least one antibody according to the invention or a composition containing optionally with another active agent, wherein the method further comprises administering an agent that elevates the availability of LDLR protein or which decreases serum cholesterol.

Another preferred embodiment of the invention relates to a method using an effective amount of at least one antibody according to the invention or a composition containing optionally with another active agent wherein the agent that elevates the availability of LDLR protein or which decreases cholesterol is administered simultaneously with the antibody or composition containing.

Another preferred embodiment of the invention relates to a method using an effective amount of at least one antibody according to the invention or a composition containing optionally with another active agent, wherein the agent that elevates the availability of LDLR protein or which decrease serum cholesterol is administered sequentially.

Another preferred embodiment of the invention relates to a method using an effective amount of at least one antibody according to the invention or a composition containing optionally with another active agent, wherein the agent that reduces serum cholesterol comprises a statin.

Another preferred embodiment of the invention relates to a method using an effective amount of at least one antibody according to the invention or a composition containing optionally with another active agent, wherein the statin comprises atorvastatin, cerivastatin, fluvastatin, lovastatin, mevastatin, pitavastatin, pravastatin, rosuvastatin, simvastatin, or a combination thereof.

Another preferred embodiment of the invention relates to a method using an effective amount of at least one antibody according to the invention or a composition containing optionally with another active agent wherein the method further comprises administering an agent that elevates the HDL level, an agent that decreases triglyceride levels, or both.

Another preferred embodiment of the invention relates to a method using an effective amount of at least one antibody according to the invention or a composition containing optionally with another active agent, wherein the agent comprises a fibrate.

Another preferred embodiment of the invention relates to a method using an effective amount of at least one antibody according to the invention or a composition containing optionally with another active agent, wherein the fibrate comprises bezafibrate, ciprofibrate, clofibrate, gemfibrozil, fenofibrate, or mixtures thereof.

Another preferred embodiment of the invention relates to a method using an effective amount of at least one antibody according to the invention or a composition containing optionally with another active agent wherein the method further comprises administering a bile sequestering agent.

Another preferred embodiment of the invention relates to a method using an effective amount of at least one antibody according to the invention or a composition containing optionally with another active agent wherein the bile sequestering agent comprises cholestyramine, colesevelam, colestipol, or mixtures thereof.

Another preferred embodiment of the invention relates to a method using an effective amount of at least one antibody according to the invention or a composition containing optionally with another active agent, wherein the method further comprises administering an agent that decreases cholesterol absorption in the intestines.

Another preferred embodiment of the invention relates to a method using an effective amount of at least one antibody according to the invention or a composition containing optionally with another active agent, wherein the agent comprises ezetimibe.

Another preferred embodiment of the invention relates to a method of any one containing an antibody according to the invention wherein the method further comprises administering an agent that inhibits hepatic triglyceride production, inhibits VLDL secretions, or both.

Another preferred embodiment of the invention relates to a method using an effective amount of at least one antibody according to the invention or a composition containing optionally with another active agent, wherein the agent comprises acipimox, Gemfibrozil or nicotinic acid, and nicotinic acid analogs.

Another preferred embodiment of the invention relates to a method using an effective amount of at least one antibody according to the invention or a composition containing optionally with another active agent, wherein the method further comprises administering an agent that decreases lipid absorption in the intestines.

Another preferred embodiment of the invention relates to a method using an effective amount of at least one antibody according to the invention or a composition containing optionally with another active agent, wherein the agent comprises orlistat, lipstatin, or mixtures thereof.

Another preferred embodiment of the invention relates to a method of using an effective amount of at least one antibody according to the invention or a composition containing optionally with another active agent wherein the antibody or antibody fragment is administered before or after other active agent.

Another embodiment relates to a method of increasing LDLR protein level in a subject, the method comprising administering to a subject an effective amount of at least one isolated antibody or antibody fragment according to the invention or a composition containing as described herein.

Another preferred embodiment of the invention relates to a method using an effective amount of at least one antibody according to the invention or a composition containing optionally with another active agent, wherein administering the at least one isolated anti-human PCSK9 antibody or antibody fragment inhibits PCSK9 binding to LDLR.

Another preferred embodiment of the invention relates to a method using an effective amount of at least one antibody according to the invention or a composition containing optionally with another active agent, wherein the method further comprises administering another agent that elevates the availability of LDLR protein or one which decreases serum cholesterol.

Another preferred embodiment of the invention relates to a method using an effective amount of at least one antibody according to the invention or a composition containing optionally with another active agent, wherein the agent that elevates the availability of LDLR protein or which decrease serum cholesterol is administered simultaneously with the antibody or antibody composition.

Another preferred embodiment of the invention relates to a method using an effective amount of at least one antibody according to the invention or a composition containing optionally with another active agent, wherein the agent that elevates the availability of LDLR protein or which reduces serum cholesterol is administered sequentially with respect to the antibody or antibody composition.

Another preferred embodiment of the invention relates to a method using an effective amount of at least one antibody according to the invention or a composition containing optionally with another active agent, wherein the agent that reduces serum cholesterol protein comprises a statin.

Another preferred embodiment of the invention relates to a method using an effective amount of at least one antibody according to the invention or a composition containing optionally with another active agent, wherein the statin comprises atorvastatin, cerivastatin, fluvastatin, lovastatin, mevastatin, pitavastatin, pravastatin, rosuvastatin, simvastatin, or a combination thereof.

Another preferred embodiment of the invention relates to a method using an effective amount of at least one antibody according to the invention or a composition containing optionally with another active agent, wherein the method further comprises administering an agent that elevates the HDL level, an agent that decreases triglyceride levels, or both.

Another preferred embodiment of the invention relates to a method using an effective amount of at least one antibody according to the invention or a composition containing optionally with another active agent, wherein the other agent comprises a fibrate.

Another preferred embodiment of the invention relates to a method using an effective amount of at least one antibody according to the invention or a composition containing optionally with another active agent, wherein the fibrate comprises bezafibrate, ciprofibrate, clofibrate, gemfibrozil, fenofibrate, or mixtures thereof.

Another preferred embodiment of the invention relates to a method using an effective amount of at least one antibody according to the invention or a composition containing optionally with another active agent 234, wherein the method further comprises administering a bile sequestering agent.

Another preferred embodiment of the invention relates to a method using an effective amount of at least one antibody according to the invention or a composition containing optionally with another active agent wherein the bile sequestering agent comprises cholestyramine, colesevelam, colestipol, or mixtures thereof.

Another preferred embodiment of the invention relates to a method using an effective amount of at least one antibody according to the invention or a composition containing optionally with another active agent wherein the method further comprises administering an agent that decreases cholesterol absorption in the intestines.

Another preferred embodiment of the invention relates to a method using an effective amount of at least one antibody according to the invention or a composition containing optionally with another active agent, wherein the agent comprises ezetimibe.

Another preferred embodiment of the invention relates to a method using an effective amount of at least one antibody according to the invention or a composition containing optionally with another active agent, wherein the method further comprises administering an agent that inhibits hepatic triglyceride production, inhibits VLDL secretions, or both.

Another preferred embodiment of the invention relates to a method using an effective amount of at least one antibody according to the invention or a composition containing optionally with another active agent, wherein the agent comprises acipimox, Gemfibrozil or nicotinic acid, or a nicotinic acid analog.

Another preferred embodiment of the invention relates to a method using an effective amount of at least one antibody according to the invention or a composition containing optionally with another active agent, wherein the method further comprises administering an agent that decreases lipid absorption in the intestines.

Another preferred embodiment of the invention relates to a method using an effective amount of at least one antibody according to the invention or a composition containing optionally with another active agent 250, wherein the agent comprises orlistat, lipstatin, or mixtures thereof.

Another preferred embodiment of the invention relates to a method using an effective amount of at least one antibody according to the invention or a composition containing optionally with another active agent, wherein the method further comprises administering an agent that is an anti-hypertensive, treats angina, or both.

Another preferred embodiment of the invention relates to a method using an effective amount of at least one antibody according to the invention or a composition containing optionally with another active agent wherein the agent comprises amlodipine, diuretic, an adrenergic receptor antagonist, a calcium channel blocker, a renin inhibitor, an ACE inhibitor, an angiotensin II receptor antagonist, aa aldosterone antagonist, a vasodilator, a nitrate or an alpha-2 agonist.

Another preferred embodiment of the invention relates to a method using an effective amount of at least one antibody according to the invention or a composition containing optionally with another active agent, wherein the diuretics include bumetanide, thacrynic acid, furosemide, and torsemide; a thiazide diuretic such as epitizide, hydrochlorothiazide or chlorothiazide, or bendroflumethiazide; a thiazide-like diuretic such as indapamide, chlorthalidone, or metolazone; a potassium-sparing diuretic such as amiloride, triamterene, or spironolactone; the adrenergic receptor antagonists include beta blockers such as atenolol, metoprolol, nadolol, oxprenolol, pindolol, propranolol, or timolol; the alpha blockers include doxazosin, phentolamine, indoramin, phenoxybenzamine, prazosin, terazosin, and tolazoline; mixed alpha+beta blockers such as bucindolol, carvedilol, and labetalol; the calcium channel blockers include dihydropyridines such as amlodipine, felodipine, isradipine, lercanidipine, nicardipine, nifedipine, nimodipine, and nitrendipine; non-dihydropyridines such as diltiazem and verapamil; renin inhibitors such as Aliskiren; an ACE inhibitors such as captopril, enalapril, fosinopril, lisinopril, perindopril, quinapril, ramipril, trandolapril, and benazepril; angiotensin II receptor antagonists such as candesartan, eprosartan, irbesartan, losartan, olmesartan, telmisartan, and valsartan; aldosterone antagonists such as eplerenone and spironolactone; vasodilators such as sodium nitroprusside; and Alpha-2 agonists such as Clonidine, Guanabenz, Methyldopa, Moxonidine, Guanethidine or Reserpine; or a nitrate such as nitroglycerin (glyceryl trinitrate), pentaerythritol tetranitrate, isosorbide dinitrate or isosorbide mononitrate.

Another preferred embodiment of the invention relates to a method using an effective amount of at least one antibody according to the invention or a composition containing optionally with another active agent wherein the antibody or antibody fragment or composition containing and at least one other agent are administered concurrently.

Another preferred embodiment of the invention relates to a method using an effective amount of at least one antibody according to the invention or a composition containing optionally with another active agent wherein the antibody or antibody fragment or composition containing and at least one other agent are administered separately, optionally by different dosing methods.

Another preferred embodiment of the invention relates to a method using an effective amount of at least one antibody according to the invention or a composition containing optionally with another active agent wherein the antibody or antibody fragment is administered before or after the at least one other agent.

Another preferred embodiment of the invention relates to a method using an effective amount of at least one antibody according to the invention or a composition containing optionally with another active agent wherein the antibody or antibody fragment or composition containing are administered with an agent that inhibits inflammation.

Another preferred embodiment of the invention relates to a method using an effective amount of at least one antibody according to the invention or a composition containing optionally with another active agent, wherein the therapeutic agent for inflammation comprises a cyclooxygenase type 1 inhibitor, a cyclooxygenase type 2 inhibitor, a small molecule modulator of p38-MAPK, a small molecule modulator of intracellular molecules involved in inflammation pathways, or mixtures thereof.

Another preferred embodiment relates to a method using an effective amount of at least one antibody according to the invention or a composition containing optionally with another active agent, that is used to treat or prevent a disease or the complications of a disease or condition selected from hypercholesterolemia, heart disease, metabolic syndrome, diabetes, coronary heart disease, stroke, cardiovascular diseases, Alzheimer's disease, dyslipidemias, elevated total serum cholesterol, elevated LDL, elevated triglycerides, elevated VLDL, low HDL, metabolic syndrome, diabetes mellitus, familial combined hyperlipidemia, familial hypertriglyceridemia, familial hypercholesterolemias, including heterozygous hypercholesterolemia, homozygous hypercholesterolemia, familial defective apolipoprotein B-100; polygenic hypercholesterolemia; remnant removal disease, hepatic lipase deficiency; dyslipidemia secondary to any of the following: dietary indiscretion, hypothyroidism, drugs including estrogen and progestin therapy, beta-blockers, and thiazide diuretics; nephrotic syndrome, chronic renal failure, Cushing's syndrome, primary biliary cirrhosis, glycogen storage diseases, hepatoma, cholestasis, acromegaly, insulinoma, isolated growth hormone deficiency, and alcohol-induced hypertriglyceridemia. atherosclerotic diseases such as coronary heart disease, coronary artery disease, peripheral arterial disease, stroke (ischaemic and hemorrhagic), angina pectoris, cerebrovascular disease and acute coronary syndrome, myocardial infarction, reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries, or the risk of recurrent cardiovascular events.

Another preferred embodiment of the invention relates to an isolated nucleic acid or nucleic acids which encode for and when expressed in a suitable host cell result in the expression of an anti-human PCSK9 antibody or antibody fragment or the variable heavy or light chain thereof, wherein said antibody or antibody fragment encoded by said nucleic acid or nucleic acids competes with and/or specifically binds to the same or overlapping epitope(s) on human PCSK9 as an anti-human PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention wherein said expressed antibody or antibody fragment specifically binds to the same or overlapping epitope(s) on human PCSK9 as an anti-human PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention, wherein said epitope(s) can be identified is a binding assay that detects the binding of an anti-human PCSK9 antibody to one or more peptides in a library of 10-15-mer peptides which are overlapping fragments that correspond to all or substantially all of the length of the human PCSK9 polypeptide.

Another preferred embodiment of the invention relates to a nucleic acid or nucleic acids that express an antibody or antibody fragment according to the invention wherein the epitope bound thereby is determined using a Western immunoblot assay which detects specific binding of the antibody or antibody fragment to one or more of said 10-15 mer peptides in said library by the use of a chemiluminescent label which emits a detectable chemiluminescent signal when specific binding of said antibody or antibody fragment to a peptide in said library occurs.

Another preferred embodiment of the invention relates to a nucleic acid or nucleic acids that express an antibody or antibody fragment according to the invention, wherein said expressed antibody or antibody fragment encoded by said nucleic acid or nucleic acids contains at least 2 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention, wherein said expressed anti-human anti-PCSK9 antibody or antibody fragment encoded by said nucleic acid or nucleic acids contains at least 3 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention, wherein said expressed anti-human PCSK9 antibody or antibody fragment encoded by said nucleic acid or nucleic acids contains at least 4 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention, wherein said expressed anti-human PCSK9 antibody or antibody fragment encoded by said nucleic acid or nucleic acids contains at least 5 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention wherein said expressed antibody or antibody fragment encoded by said nucleic acid or nucleic acids contains all 6 complementarity determining regions (CDRs) of an anti-PCSK9 antibody selected from the group consisting of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23 and Ab24.

Another preferred embodiment of the invention relates to a nucleic acid or nucleic acids that express an antibody or antibody fragment according to the invention wherein said expressed anti-human PCSK9 antibody or antibody fragment encoded by said nucleic acid or nucleic acids contains (a) a variable heavy chain comprising a CDR1 sequence selected from the group consisting of SEQ ID NO: 4, SEQ ID NO: 44, SEQ ID NO: 84, SEQ ID NO: 124, SEQ ID NO: 164, SEQ ID NO: 204, SEQ ID NO: 244, SEQ ID NO: 284, SEQ ID NO: 324, SEQ ID NO: 364, SEQ ID NO: 404, SEQ ID NO: 444, SEQ ID NO: 484, SEQ ID NO: 524, SEQ ID NO: 564, SEQ ID NO: 604, SEQ ID NO: 644, SEQ ID NO: 684, SEQ ID NO: 724, SEQ ID NO: 764, SEQ ID NO: 804, SEQ ID NO: 844, SEQ ID NO: 884, and SEQ ID NO: 924; a CDR2 sequence selected from the group consisting of SEQ ID NO: 6, SEQ ID NO: 46, SEQ ID NO: 86, SEQ ID NO: 126, SEQ ID NO: 166, SEQ ID NO: 206, SEQ ID NO: 246, SEQ ID NO: 286, SEQ ID NO: 326, SEQ ID NO: 366, SEQ ID NO: 406, SEQ ID NO: 446, SEQ ID NO: 486, SEQ ID NO: 526, SEQ ID NO: 566, SEQ ID NO: 606, SEQ ID NO: 646, SEQ ID NO: 686, SEQ ID NO: 726, SEQ ID NO: 766, SEQ ID NO: 806, SEQ ID NO: 846, SEQ ID NO: 886, and SEQ ID NO: 926; and a CDR3 sequence selected from the group consisting of SEQ ID NO: 8, SEQ ID NO: 48, SEQ ID NO: 88, SEQ ID NO: 128, SEQ ID NO: 168, SEQ ID NO: 208, SEQ ID NO: 248, SEQ ID NO: 288, SEQ ID NO: 328, SEQ ID NO: 368, SEQ ID NO: 408, SEQ ID NO: 448, SEQ ID NO: 488, SEQ ID NO: 528, SEQ ID NO: 568, SEQ ID NO: 608, SEQ ID NO: 648, SEQ ID NO: 688, SEQ ID NO: 728, SEQ ID NO: 768, SEQ ID NO: 808, SEQ ID NO: 848, SEQ ID NO: 888, and SEQ ID NO: 928; and/or (b) a variable light chain comprising a CDR1 sequence selected from the group consisting of SEQ ID NO: 24, SEQ ID NO: 64, SEQ ID NO: 104, SEQ ID NO: 144, SEQ ID NO: 184, SEQ ID NO: 224, SEQ ID NO: 264, SEQ ID NO: 304, SEQ ID NO: 344, SEQ ID NO: 384, SEQ ID NO: 424, SEQ ID NO: 464, SEQ ID NO: 504, SEQ ID NO: 544, SEQ ID NO: 584, SEQ ID NO: 624, SEQ ID NO: 664, SEQ ID NO: 704, SEQ ID NO: 744, SEQ ID NO: 784, SEQ ID NO: 824, SEQ ID NO: 864, SEQ ID NO: 904, and SEQ ID NO: 944; a CDR2 sequence selected from the group consisting of SEQ ID NO: 26, SEQ ID NO: 66, SEQ ID NO: 106, SEQ ID NO: 146, SEQ ID NO: 186, SEQ ID NO: 226, SEQ ID NO: 266, SEQ ID NO: 306, SEQ ID NO: 346, SEQ ID NO: 386, SEQ ID NO: 426, SEQ ID NO: 466, SEQ ID NO: 506, SEQ ID NO: 546, SEQ ID NO: 586, SEQ ID NO: 626, SEQ ID NO: 666, SEQ ID NO: 706, SEQ ID NO: 746, SEQ ID NO: 786, SEQ ID NO: 826, SEQ ID NO: 866, SEQ ID NO: 906, and SEQ ID NO: 946; and a CDR3 sequence selected from the group consisting of SEQ ID NO: 28, SEQ ID NO: 68, SEQ ID NO: 108, SEQ ID NO: 148, SEQ ID NO: 188, SEQ ID NO: 228, SEQ ID NO: 268, SEQ ID NO: 308, SEQ ID NO: 348, SEQ ID NO: 388, SEQ ID NO: 428, SEQ ID NO: 468, SEQ ID NO: 508, SEQ ID NO: 548, SEQ ID NO: 588, SEQ ID NO: 628, SEQ ID NO: 668, SEQ ID NO: 708, SEQ ID NO: 748, SEQ ID NO: 788, SEQ ID NO: 828, SEQ ID NO: 868, SEQ ID NO: 908, and SEQ ID NO: 948, with the further proviso that one or two residues of any of the afore-identified CDR polypeptides may be substituted with another amino acid.

Another preferred embodiment of the invention relates to a nucleic acid or nucleic acids that express an antibody or antibody fragment according to the invention, wherein the variable heavy chain encoded by said nucleic acid or nucleic acids comprises the CDR1 sequence of SEQ ID NO: 4, the CDR2 sequence of SEQ ID NO: 6, and the CDR3 sequence of SEQ ID NO: 8; and/or the variable light chain comprises the CDR1 sequence of SEQ ID NO: 24, the CDR2 sequence of SEQ ID NO: 26, and the CDR3 sequence of SEQ ID NO: 28.

Another preferred embodiment of the invention relates to a nucleic acid or nucleic acids that express an antibody or antibody fragment according to the invention, wherein the variable heavy chain encoded by said nucleic acid or nucleic acids comprises the CDR1 sequence of SEQ ID NO: 44, the CDR2 sequence of SEQ ID NO: 46, and the CDR3 sequence of SEQ ID NO: 48; and/or the variable light chain comprises the CDR1 sequence of SEQ ID NO: 64, the CDR2 sequence of SEQ ID NO: 66, and the CDR3 sequence of SEQ ID NO: 68.

Another preferred embodiment of the invention relates to a nucleic acid or nucleic acids that express an antibody or antibody fragment according to the invention wherein the variable heavy chain encoded by said nucleic acid or nucleic acids comprises the CDR1 sequence of SEQ ID NO: 84, the CDR2 sequence of SEQ ID NO: 86, and the CDR3 sequence of SEQ ID NO: 88; and/or the variable light chain comprises the CDR1 sequence of SEQ ID NO: 104, the CDR2 sequence of SEQ ID NO: 106, and the CDR3 sequence of SEQ ID NO: 108.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 124, the CDR2 sequence of SEQ ID NO: 126, and the CDR3 sequence of SEQ ID NO: 128; and/or the variable light chain comprises the CDR1 sequence of SEQ ID NO: 144, the CDR2 sequence of SEQ ID NO: 146, and the CDR3 sequence of SEQ ID NO: 148.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 164, the CDR2 sequence of SEQ ID NO: 166, and the CDR3 sequence of SEQ ID NO: 168; and the variable light chain comprises the CDR1 sequence of SEQ ID NO: 184, the CDR2 sequence of SEQ ID NO: 186, and the CDR3 sequence of SEQ ID NO: 188.

Another preferred embodiment of the invention relates to a nucleic acid or nucleic acids encoding an antibody according to the invention, wherein said expressed anti-human PCSK9 antibody or antibody fragment contains a variable heavy chain that comprises the CDR1 sequence of SEQ ID NO: 204, the CDR2 sequence of SEQ ID NO: 206, and the CDR3 sequence of SEQ ID NO: 208; and the variable light chain comprises the CDR1 sequence of SEQ ID NO: 224, the CDR2 sequence of SEQ ID NO: 226, and the CDR3 sequence of SEQ ID NO: 228.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 244, the CDR2 sequence of SEQ ID NO: 246, and the CDR3 sequence of SEQ ID NO: 248; and the variable light chain comprises the CDR1 sequence of SEQ ID NO: 264, the CDR2 sequence of SEQ ID NO: 266, and the CDR3 sequence of SEQ ID NO: 268.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 284, the CDR2 sequence of SEQ ID NO: 286, and the CDR3 sequence of SEQ ID NO: 288; and the variable light chain comprises the CDR1 sequence of SEQ ID NO: 304, the CDR2 sequence of SEQ ID NO: 306, and the CDR3 sequence of SEQ ID NO: 308.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 324, the CDR2 sequence of SEQ ID NO: 326, and the CDR3 sequence of SEQ ID NO: 328; and/or the variable light chain comprises the CDR1 sequence of SEQ ID NO: 344, the CDR2 sequence of SEQ ID NO: 346, and the CDR3 sequence of SEQ ID NO: 348.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 364, the CDR2 sequence of SEQ ID NO: 366, and the CDR3 sequence of SEQ ID NO: 368; and/or the variable light chain comprises the CDR1 sequence of SEQ ID NO: 384, the CDR2 sequence of SEQ ID NO: 386, and the CDR3 sequence of SEQ ID NO: 388.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 404, the CDR2 sequence of SEQ ID NO: 406, and the CDR3 sequence of SEQ ID NO: 408; and/or the variable light chain comprises the CDR1 sequence of SEQ ID NO: 424, the CDR2 sequence of SEQ ID NO: 426, and the CDR3 sequence of SEQ ID NO: 428.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 444, the CDR2 sequence of SEQ ID NO: 446, and the CDR3 sequence of SEQ ID NO: 448; and the variable light chain comprises the CDR1 sequence of SEQ ID NO: 464, the CDR2 sequence of SEQ ID NO: 466, and the CDR3 sequence of SEQ ID NO: 468.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 484, the CDR2 sequence of SEQ ID NO: 486, and the CDR3 sequence of SEQ ID NO: 488; and/or the variable light chain comprises the CDR1 sequence of SEQ ID NO: 504, the CDR2 sequence of SEQ ID NO: 506, and the CDR3 sequence of SEQ ID NO: 508.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 524, the CDR2 sequence of SEQ ID NO: 526, and the CDR3 sequence of SEQ ID NO: 528; and/or the variable light chain comprises the CDR1 sequence of SEQ ID NO: 544, the CDR2 sequence of SEQ ID NO: 546, and the CDR3 sequence of SEQ ID NO: 548.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 564, the CDR2 sequence of SEQ ID NO: 566, and the CDR3 sequence of SEQ ID NO: 568; and/or the variable light chain comprises the CDR1 sequence of SEQ ID NO: 584, the CDR2 sequence of SEQ ID NO: 586, and the CDR3 sequence of SEQ ID NO: 588.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 604, the CDR2 sequence of SEQ ID NO: 606, and the CDR3 sequence of SEQ ID NO: 608; and/or the variable light chain comprises the CDR1 sequence of SEQ ID NO: 624, the CDR2 sequence of SEQ ID NO: 626, and the CDR3 sequence of SEQ ID NO: 628.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 644, the CDR2 sequence of SEQ ID NO: 646, and the CDR3 sequence of SEQ ID NO: 648; and/or the variable light chain comprises the CDR1 sequence of SEQ ID NO: 664, the CDR2 sequence of SEQ ID NO: 666, and the CDR3 sequence of SEQ ID NO: 668.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 684, the CDR2 sequence of SEQ ID NO: 686, and the CDR3 sequence of SEQ ID NO: 688; and/or the variable light chain comprises the CDR1 sequence of SEQ ID NO: 704, the CDR2 sequence of SEQ ID NO: 706, and the CDR3 sequence of SEQ ID NO: 708.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 724, the CDR2 sequence of SEQ ID NO: 726, and the CDR3 sequence of SEQ ID NO: 728; and/or the variable light chain comprises the CDR1 sequence of SEQ ID NO: 744, the CDR2 sequence of SEQ ID NO: 746, and the CDR3 sequence of SEQ ID NO: 748.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 764, the CDR2 sequence of SEQ ID NO: 766, and the CDR3 sequence of SEQ ID NO: 768; and/or the variable light chain comprises the CDR1 sequence of SEQ ID NO: 784, the CDR2 sequence of SEQ ID NO: 786, and the CDR3 sequence of SEQ ID NO: 788.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 804, the CDR2 sequence of SEQ ID NO: 806, and the CDR3 sequence of SEQ ID NO: 808; and/or the variable light chain comprises the CDR1 sequence of SEQ ID NO: 824, the CDR2 sequence of SEQ ID NO: 826, and the CDR3 sequence of SEQ ID NO: 828.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 844, the CDR2 sequence of SEQ ID NO: 846, and the CDR3 sequence of SEQ ID NO: 848; and/or the variable light chain comprises the CDR1 sequence of SEQ ID NO: 864, the CDR2 sequence of SEQ ID NO: 866, and the CDR3 sequence of SEQ ID NO: 868.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 884, the CDR2 sequence of SEQ ID NO: 886, and the CDR3 sequence of SEQ ID NO: 888; and/or the variable light chain encoded by said nucleic acid or nucleic acids comprises the CDR1 sequence of SEQ ID NO: 904, the CDR2 sequence of SEQ ID NO: 906, and the CDR3 sequence of SEQ ID NO: 908.

Another preferred embodiment of the invention relates to a nucleic acid or nucleic acids encoding an antibody according to the invention, wherein the variable heavy chain encoded by said nucleic acid or nucleic acids comprises the CDR1 sequence of SEQ ID NO: 924, the CDR2 sequence of SEQ ID NO: 926, and the CDR3 sequence of SEQ ID NO: 928; and/or the variable light chain encoded by said nucleic acid or nucleic acids comprises the CDR1 sequence of SEQ ID NO: 944, the CDR2 sequence of SEQ ID NO: 946, and the CDR3 sequence of SEQ ID NO: 948.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 2 and/or the variable light chain encoded by said nucleic acid or nucleic acids comprises SEQ ID NO: 22.

Another preferred embodiment of the invention relates to a nucleic acid or nucleic acids encoding an antibody according to the invention, wherein the variable heavy and light chains are each at least 90% identical to the variable heavy and light chains in SEQ ID NO: 2 and SEQ ID NO: 22, respectively.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 42 and the variable light chain encoded by said nucleic acid or nucleic acids comprises a sequence at least 80, 85, 90, 95, 96, 97, 98, 99 or 100% identical to SEQ ID NO: 62.

Another preferred embodiment of the invention relates to a nucleic acid or nucleic acids encoding an antibody according to the invention, wherein the variable heavy and light chains are each at least 90% identical to the variable heavy and light chains in SEQ ID NO: 42 and SEQ ID NO: 62, respectively.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 82 and the variable light chain encoded by said nucleic acid or nucleic acids comprises a sequence at least 80, 85, 90, 95, 96, 97, 98, 99 or 100% identical to SEQ ID NO: 102.

Another preferred embodiment of the invention relates to a nucleic acid or nucleic acids encoding an antibody according to the invention, wherein the variable heavy and light chains are each at least 90% identical to the variable heavy and light chains in SEQ ID NO: 82 and SEQ ID NO: 102, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 122 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 142.

Another preferred embodiment of the invention relates to a nucleic acid or nucleic acids encoding an antibody according to the invention, wherein the variable heavy and light chains are each at least 90% identical to the variable heavy and light chains in SEQ ID NO: 122 and SEQ ID NO: 142, respectively.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 162 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 182.

Another preferred embodiment of the invention relates to a nucleic acid or nucleic acids encoding an antibody according to the invention, wherein the variable heavy and light chains are each at least 90% identical to the variable heavy and light chains in SEQ ID NO: 162 and SEQ ID NO: 182, respectively.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 202 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 222.

Another preferred embodiment of the invention relates to a nucleic acid or nucleic acids encoding an antibody according to the invention, wherein the variable heavy and light chains are each at least 90% identical to the variable heavy and light chains in SEQ ID NO: 202 and SEQ ID NO: 222, respectively.

Another preferred embodiment of the invention relates to a nucleic acid or nucleic acids encoding an antibody according to the invention, wherein the variable heavy chain encoded by said nucleic acid or nucleic acids comprises a sequence at least 80, 85, 90, 95, 96, 97, 98, 99 or 100% identical to SEQ ID NO: 242 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 262.

Another preferred embodiment of the invention relates to a nucleic acid or nucleic acids encoding an antibody according to the invention, 47, wherein the variable heavy and light chains are each at least 90% identical to the variable heavy and light chains in SEQ ID NO: 242 and SEQ ID NO: 262, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 282 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 302.

Another preferred embodiment of the invention relates to a nucleic acid or nucleic acids encoding an antibody according to the invention, wherein the variable heavy and light chains are each at least 90% identical to the variable heavy and light chains in SEQ ID NO: 282 and SEQ ID NO: 302, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 322 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 342.

Another preferred embodiment of the invention relates to a nucleic acid or nucleic acids encoding an antibody according to the invention, wherein the variable heavy and light chains are each at least 90% identical to the variable heavy and light chains in SEQ ID NO: 322 and SEQ ID NO: 342, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 362 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 382.

Another preferred embodiment of the invention relates to a nucleic acid or nucleic acids encoding an antibody according to the invention, wherein the variable heavy and light chains are each at least 90% identical to the variable heavy and light chains in SEQ ID NO: 362 and SEQ ID NO: 382, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 402 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 422.

Another preferred embodiment of the invention relates to a nucleic acid or nucleic acids encoding an antibody according to the invention, 55, wherein the variable heavy and light chains are each at least 90% identical to the variable heavy and light chains in SEQ ID NO: 402 and SEQ ID NO: 422, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 442 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 462.

Another preferred embodiment of the invention relates to a nucleic acid or nucleic acids encoding an antibody according to the invention, wherein the variable heavy and light chains are each at least 90% identical to the variable heavy and light chains in SEQ ID NO: 442 and SEQ ID NO: 462, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 482 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 502.

Another preferred embodiment of the invention relates to a nucleic acid or nucleic acids encoding an antibody according to the invention, wherein the variable heavy and light chains are each at least 90% identical to the variable heavy and light chains in SEQ ID NO: 482 and SEQ ID NO: 502, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 522 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 542.

Another preferred embodiment of the invention relates to a nucleic acid or nucleic acids encoding an antibody according to the invention, wherein the variable heavy and light chains are each at least 90% identical to the variable heavy and light chains in SEQ ID NO: 522 and SEQ ID NO: 542, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 562 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 582.

Another preferred embodiment of the invention relates to a nucleic acid or nucleic acids encoding an antibody according to the invention, wherein the variable heavy and light chains are each at least 90% identical to the variable heavy and light chains in SEQ ID NO: 562 and SEQ ID NO: 582, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 602 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 622.

Another preferred embodiment of the invention relates to a nucleic acid or nucleic acids encoding an antibody according to the invention, wherein the variable heavy and light chains are each at least 90% identical to the variable heavy and light chains in SEQ ID NO: 602 and SEQ ID NO: 622, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 642 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 662.

Another preferred embodiment of the invention relates to a nucleic acid or nucleic acids encoding an antibody according to the invention, wherein the variable heavy and light chains are each at least 90% identical to the variable heavy and light chains in SEQ ID NO: 642 and SEQ ID NO: 662, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 682 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 702.

Another preferred embodiment of the invention relates to a nucleic acid or nucleic acids encoding an antibody according to the invention, wherein the variable heavy and light chains are each at least 90% identical to the variable heavy and light chains in SEQ ID NO: 682 and SEQ ID NO: 702, respectively Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 722 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 742.

Another preferred embodiment of the invention relates to a nucleic acid or nucleic acids encoding an antibody according to the invention, wherein the variable heavy and light chains are each at least 90% identical to the variable heavy and light chains in SEQ ID NO: 722 and SEQ ID NO: 742, respectively Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 762 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 782.

Another preferred embodiment of the invention relates to a nucleic acid or nucleic acids encoding an antibody according to the invention, wherein the variable heavy and light chains are each at least 90% identical to the variable heavy and light chains in SEQ ID NO: 762 and SEQ ID NO: 782, respectively Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 802 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 822.

Another preferred embodiment of the invention relates to a nucleic acid or nucleic acids encoding an antibody according to the invention, wherein the variable heavy and light chains are each at least 90% identical to the variable heavy and light chains in SEQ ID NO: 802 and SEQ ID NO: 822, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 842 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 862.

Another preferred embodiment of the invention relates to a nucleic acid or nucleic acids encoding an antibody according to the invention, wherein the variable heavy and light chains are each at least 90% identical to the variable heavy and light chains in SEQ ID NO: 842 and SEQ ID NO: 862, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 882 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 902.

Another preferred embodiment of the invention relates to a nucleic acid or nucleic acids encoding an antibody according to the invention, wherein the variable heavy and light chains are each at least 90% identical to the variable heavy and light chains in SEQ ID NO: 882 and SEQ ID NO: 902, respectively.

Another preferred embodiment of the invention relates to a nucleic acid or nucleic acids encoding an antibody according to the invention, wherein the variable heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 922 and the variable light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 942.

Another preferred embodiment of the invention relates to a nucleic acid or nucleic acids encoding an antibody according to the invention, wherein the variable heavy and light chains are each at least 90% identical to the variable heavy and light chains in SEQ ID NO: 922 and SEQ ID NO: 942, respectively.

Another preferred embodiment of the invention relates to a nucleic acid or nucleic acids encoding an antibody according to the invention, wherein the heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 1 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 21.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 41 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 61.

Another preferred embodiment of the invention relates to a nucleic acid or nucleic acids encoding an antibody according to the invention, wherein the heavy chain encoded by said nucleic acid or nucleic acids comprises encoded by said nucleic acid or nucleic acids comprises a sequence is at least 80, 85, 90, 95, 96, 97, 98, 99 or 100% identical to SEQ ID NO: 81 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 101.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 121 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 141.

Another preferred embodiment of the invention relates to a nucleic acid or nucleic acids encoding an antibody according to the invention, wherein the heavy chain encoded by said nucleic acid or nucleic acids a sequence at least 80, 85, 90, 95, 96, 97, 98, 99 or 100% identical to SEQ ID NO: 161 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 181.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 201 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 221.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 241 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 261.

Another preferred embodiment of the invention relates to a nucleic acid or nucleic acids encoding an antibody according to the invention, wherein the heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 281 and the light chain encoded by said nucleic acid or nucleic acids comprises SEQ ID NO: 301.

Another preferred embodiment of the invention relates to a nucleic acid or nucleic acids encoding an antibody according to the invention, wherein the heavy chain encoded by said nucleic acid or nucleic acids comprises SEQ ID NO: 321 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 341.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 361 and the light chain encoded by said nucleic acid or nucleic acids comprises SEQ ID NO: 381.

Another preferred embodiment of the invention relates to a nucleic acid or nucleic acids encoding an antibody according to the invention, wherein the heavy chain encoded by said nucleic acid or nucleic acids comprises SEQ ID NO: 401 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 421.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 441 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 461.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 481 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 501.

Another preferred embodiment of the invention relates to a nucleic acid or nucleic acids encoding an antibody according to the invention, wherein the heavy chain encoded by said nucleic acid or nucleic acids comprises a sequence at least 80, 85, 90, 95, 96, 97, 98, 99 or 100% identical to SEQ ID NO: 521 and the light chain encoded by said nucleic acid or nucleic acids comprises SEQ ID NO: 541.

Another preferred embodiment of the invention relates to a nucleic acid or nucleic acids encoding an antibody according to the invention, wherein the heavy chain encoded by said nucleic acid or nucleic acids comprises SEQ ID NO: 561 and the light chain encoded by said nucleic acid or nucleic acids comprises a sequence at least 80, 85, 90, 95, 96, 97, 98, 99 or 100% identical to SEQ ID NO: 581.

Another preferred embodiment of the invention relates to a nucleic acid or nucleic acids encoding an antibody according to the invention, wherein the heavy chain encoded by said nucleic acid or nucleic acids a sequence at least 80, 85, 90, 95, 96, 97, 98, 99 or 100% identical to SEQ ID NO: 601 and the light chain encoded by said nucleic acid or nucleic acids comprises SEQ ID NO: 621.

Another preferred embodiment of the invention relates to a nucleic acid or nucleic acids encoding an antibody according to the invention, wherein the heavy chain encoded by said nucleic acid or nucleic acids comprises SEQ ID NO: 641 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 661.

Another preferred embodiment of the invention relates to a nucleic acid or nucleic acids encoding an antibody according to the invention, wherein the heavy chain encoded by said nucleic acid or nucleic acids comprises s a sequence at least 80, 85, 90, 95, 96, 97, 98, 99 or 100% identical to SEQ ID NO: 681 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 701.

Another preferred embodiment of the invention relates to a nucleic acid or nucleic acids encoding an antibody according to the invention, wherein the heavy chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 721 and the light chain encoded by said nucleic acid or nucleic acids comprises SEQ ID NO: 741.

Another preferred embodiment of the invention relates to a nucleic acid or nucleic acids encoding an antibody according to the invention, wherein the heavy chain encoded by said nucleic acid or nucleic acids comprises SEQ ID NO: 761 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 781.

Another preferred embodiment of the invention relates to a nucleic acid or nucleic acids encoding an antibody according to the invention, wherein the heavy chain encoded by said nucleic acid or nucleic acids comprises a sequence that is at least 80, 85, 90, 95, 96, 97, 98, 99 or 100% identical to SEQ ID NO: 801 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 821.

Another preferred embodiment of the invention relates to a nucleic acid or nucleic acids encoding an antibody according to the invention, wherein the heavy chain encoded by said nucleic acid or nucleic acids comprises a sequence that is at least 80, 85, 90, 95, 96, 97, 98, 99 or 100% identical to SEQ ID NO: 841 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 861.

Another preferred embodiment of the invention relates to a nucleic acid or nucleic acids encoding an antibody according to the invention, wherein the heavy chain encoded by said nucleic acid or nucleic acids comprises a sequence that is at least 80, 85, 90, 95, 96, 97, 98, 99 or 100% identical to SEQ ID NO: 881 and the light chain encoded by said nucleic acid or nucleic acids comprises SEQ ID NO: 901.

Another preferred embodiment of the invention relates to a nucleic acid or nucleic acids that encode an antibody according to the invention wherein the heavy chain encoded by said nucleic acid or nucleic acids comprises SEQ ID NO: 921 and the light chain encoded by said nucleic acid or nucleic acids comprises encoded by said nucleic acid or nucleic acids comprises a sequence at least 80, 85, 90, 95, 96, 97, 98, 99 or 100% identical to SEQ ID NO: 941.

Another preferred embodiment of the invention relates to a nucleic acid or nucleic acids encoding an antibody according to the invention wherein the antibody or antibody fragment encoded by said nucleic acid or nucleic acids is selected from the group consisting of chimeric, humanized, and human antibodies or antibody fragments.

Another preferred embodiment of the invention relates to a nucleic acid or nucleic acids encoding an antibody according to the invention, wherein the expressed antibody or antibody fragment encoded by said nucleic acid or nucleic acids is selected from the group consisting of scFvs, camelbodies, nanobodies, IgNAR, $F_{ab}$ fragments, $F_{ab'}$ fragments, MetMabs, monovalent antibody fragments, and $F_{(ab')2}$ fragments.

Another preferred embodiment of the invention relates to a nucleic acid or nucleic acids encoding an antibody according to the invention, wherein the expressed antibody or antibody fragment encoded by said nucleic acid or nucleic acids substantially or entirely lacks N-glycosylation and/or O-glycosylation.

Another preferred embodiment of the invention relates to a nucleic acid or nucleic acids encoding an antibody according to the invention, wherein the expressed antibody or antibody fragment encoded by said nucleic acid or nucleic acids comprises a human constant domain.

Another preferred embodiment of the invention relates to a nucleic acid or nucleic acids encoding an antibody according to the invention, wherein the expressed antibody encoded by said nucleic acid or nucleic acids is an IgG1, IgG2, IgG3, or IgG4 antibody.

Another preferred embodiment of the invention relates to a nucleic acid or nucleic acids encoding an antibody according to the invention, wherein said nucleic acid or nucleic acids which encode said antibody or antibody fragment comprise a sequence encoding a VH and a VL region at least 80, 90, 95, 96, 97, 98, 99 or 100% identical to SEQ ID NO: 12, SEQ ID NO: 32; SEQ ID NO: 52, SEQ ID NO: 72; SEQ ID NO: 92, SEQ ID NO: 112; SEQ ID NO: 132, SEQ ID NO: 152; SEQ ID NO: 172, SEQ ID NO: 192; SEQ ID NO: 212, SEQ ID NO: 232, SEQ ID NO: 252, SEQ ID NO: 272; SEQ ID NO: 292; SEQ ID NO: 312; SEQ ID NO: 332, SEQ ID NO: 352; SEQ ID NO: 372, SEQ ID NO: 392; SEQ ID NO: 412, SEQ ID NO: 432; SEQ ID NO: 452, SEQ ID NO: 472; SEQ ID NO: 492; SEQ ID NO: 512, SEQ ID NO: 532, SEQ ID NO: 552, SEQ ID NO: 572, SEQ ID NO: 592, SEQ ID NO: 612, SEQ ID NO: 632, SEQ ID NO: 652, SEQ ID NO: 672; SEQ ID NO: 692; SEQ ID NO: 712; SEQ ID NO: 732; SEQ ID NO: 752; SEQ ID NO: 772; SEQ ID NO: 792; SEQ ID NO: 812; SEQ ID NO: 832; SEQ ID NO: 852; SEQ ID NO: 872; SEQ ID NO: 892; SEQ ID NO: 912; SEQ ID NO: 932; SEQ ID NO: 952; or a codon degenerate thereof.

A vector or vectors comprising the nucleic acid sequence or sequences encoding an antibody according to the invention.

A host cell comprising nucleic acid sequence or sequences encoding an antibody according to the invention or a vector or vectors containing.

Another preferred embodiment of the invention relates to an host cell containing a nucleic acid or acids encoding an antibody according to the invention, wherein said host cell is a mammalian, bacterial, fungal, yeast, avian or insect cell.

Another preferred embodiment of the invention relates to an host cell encoding an antibody according to the invention, which comprises a filamentous fungi or a yeast.

Another preferred embodiment of the invention relates to an host cell encoding an antibody according to the invention, which comprises a filamentous fungi or yeast include *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa*.

Another preferred embodiment of the invention relates to an host cell encoding an antibody according to the invention, wherein said host cell is a mammalian cell.

Another preferred embodiment of the invention relates to an host cell encoding an antibody according to the invention, wherein said host cell is a CHO, COS, BHK, myeloma, monkey kidney CV1 line transformed by SV40 (COS-7, ATCC CRL 1651); human embryonic kidney line (293 or 293 cells subcloned for growth in suspension culture), mouse sertoli cell; human lung cell; human liver cell, or a mouse mammary tumor cell.

Another preferred embodiment of the invention relates to an host cell encoding an antibody according to the invention, wherein the mammalian cell is a CHO cell.

Another preferred embodiment of the invention relates to an host cell encoding an antibody according to the invention, which is yeast cell belonging to the genus *Pichia*.

Another preferred embodiment of the invention relates to an host cell encoding an antibody according to the invention, which is a *Pichia pastoris*.

A method of making the antibody or antibody fragment according to the invention, by expressing nucleic acids which encode for the expression of said antibody or antibody fragment in a recombinant host cell.

Another preferred embodiment of the invention relates to a method using a cell that expresses an antibody according to the invention wherein the host cell is selected from a bacteria, yeast, fungi, insect cell, plant cell, avian cell, or mammalian cell.

Another preferred embodiment of the invention relates to a method of using a cell that expresses an antibody according to the invention, wherein the host cell is a yeast or a filamentous fungi, which may optimally be polyploidal.

Another preferred embodiment of the invention relates to a method of using a cell that expresses an antibody according to the invention, wherein said a yeast or a filamentous fungi include *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa*.

Another preferred embodiment of the invention relates to a method of using a cell that expresses an antibody according to the invention, wherein said host cell is a mammalian cell.

Another preferred embodiment of the invention relates to a method of using a cell that expresses an antibody according to the invention, wherein said host cell is a CHO, COS, BHK, myeloma, monkey kidney CV1 line transformed by SV40 (COS-7, ATCC CRL 1651); human embryonic kidney line (293 or 293 cells subcloned for growth in suspension culture), mouse sertoli cell; human lung cell; human liver cell, or a mouse mammary tumor cell.

Another preferred embodiment of the invention relates to a method of using a cell that expresses an antibody according to the invention, wherein the mammalian cell is a CHO cell.

Another preferred embodiment of the invention relates to a method of 383, wherein the recombinant host cell is a polyploid yeast culture that stably expresses and secretes into the culture medium at least 10-25 mg/liter of said antibody or antibody fragment.

Another preferred embodiment of the invention relates to a method of using a cell that expresses an antibody according to the invention, wherein the cell is a polyploidal yeast made by a method that comprises:
  (i) introducing at least one expression vector containing one or more heterologous polynucleotides encoding said antibody operably linked to a promoter and a signal sequence into a haploid yeast cell;
  (ii) producing by mating or spheroplast fusion a polyploidal yeast from said first and/or second haploid yeast cell;
  (iii) selecting polyploidal yeast cells that stably express said antibody; and (iv) producing stable polyploidal yeast cultures from said polyploidal yeast cells that stably express said antibody into the culture medium.

Another preferred embodiment of the invention relates to a method of using a yeast cell that expresses an antibody according to the invention, wherein said yeast is of the genera *Pichia*.

Another preferred embodiment relates to any therapeutic or diagnostic method that comprises the administration of a therapeutically or diagnostically effective amount of at least one antibody or antibody fragment according to the invention.

Another preferred embodiment of the invention relates to a method of using an antibody according to the invention, wherein the antibody or antibody fragment is administered by a means selected from buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal.

Another preferred embodiment of the invention relates to a method of using an antibody according to the invention, wherein the antibody or antibody fragment is administered by a means selected from subcutaneous, intravenous, intraarterial, intracardial, intracerebroventricular, intramuscular, intraperitoneal, intraspinal, intrathecal, and parenteral.

Another preferred embodiment of the invention relates to a method of using an antibody according to the invention, wherein the antibody or antibody fragment is administered by subcutaneous means.

Another preferred embodiment of the invention relates to a method of using an antibody according to the invention wherein the antibody or antibody fragment is administered by intravenous means.

Another preferred embodiment of the invention relates to a method of using an antibody according to the invention, wherein the antibody or antibody fragment is contained in a powder, liquid, gel, drop, or other means of administration.

Another preferred embodiment of the invention relates to a composition containing an antibody or antibody fragment according to the invention, which is suitable for administration by a means selected from buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal.

Another preferred embodiment of the invention relates to an composition containing an antibody according to the invention, wherein the composition is administrable by a means selected from subcutaneous, intravenous, intraarterial, intracardial, intracerebroventricular, intramuscular, intraperitoneal, intraspinal, intrathecal, and parenteral.

Another preferred embodiment of the invention relates to an composition encoding an antibody according to the invention, which is administrable by subcutaneous means.

Another preferred embodiment of the invention relates to a composition which is administrable by intravenous means.

Another preferred embodiment of the invention relates to a composition which comprises a powder, liquid, gel, drop, liposomal, or other dosage form.

Another preferred embodiment of the invention relates to a method of using an antibody or antibody fragment according to the invention to isolate, detect or purify PCSK9 in a sample.

Another preferred embodiment of the invention relates a method of using an antibody or antibody fragment according to the invention to detect the levels of PCSK9 in vivo or ex vivo.

Another preferred embodiment of the invention relates to a method of using the subject antibodies to assess whether a patient should be administered an anti-PCSK9 antibody or antibody fragment or other therapy.

Another preferred embodiment of the invention relates to detection method using the subject antibodies to assess the efficacy of a treatment method the objective of which is to reduce cholesterol or alter lipid levels.

DETAILED DESCRIPTION OF PREFERRED EMBODIMENTS

Antibodies and binding fragments thereof that bind to PCSK9 are disclosed herein. In some embodiments, the antibody or antibody fragment according to the invention bind to PCSK9 and prevent PCSK9 from functioning in various ways. In some embodiments, the antibody or antibody fragment according to the invention block or reduce the ability of PCSK9 to interact with other substances, e.g., LDLR. For example, in some embodiments, the antibody or antibody fragment according to the invention binds to PCSK9 in a manner that prevents or reduces the likelihood that PCSK9 will bind to LDLR. In other embodiments, antibody or antibody fragment according to the invention bind to PCSK9 but do not block PCSK9's ability to interact with LDLR. In some embodiments, the antibody or antibody fragment according to the invention are human monoclonal antibodies.

As will be appreciated by one of skill in the art, altering the interactions between PCSK9 and LDLR can increase the amount of LDLR available for binding to LDL, which in turn decreases the amount of serum LDL-C in a subject, resulting in a reduction in the subject's serum cholesterol level. As such, an antibody or antibody fragment according to the invention can be used in various methods and compositions for treating subjects with elevated serum cholesterol levels, at risk of elevated serum cholesterol levels, or which could benefit from a reduction in their serum cholesterol levels. These conditions include any of the afore-mentioned conditions. Thus, various methods and techniques for lowering, maintaining, or preventing an increase in serum cholesterol are also described herein. In some embodiments, the antibody or antibody fragment according to the invention allows for binding between PCSK9 and LDLR, but the antibody or antibody fragment according to the invention prevents or reduces the adverse activity of PCSK9 on LDLR. In some embodiments, the antibody or antibody fragment according to the invention prevents or reduces the binding of PCSK9 to LDLR.

For convenience, the following sections generally outline the various meanings of the terms used herein. Following this discussion, general aspects regarding antibody or antibody fragment according to the invention are discussed, followed by specific examples demonstrating the properties of various embodiments of the antibody or antibody fragment according to the invention and how they can be employed.

DEFINITIONS

It is to be understood that this invention is not limited to the particular methodology, protocols, cell lines, animal species or genera, and reagents described, as such may vary. It is also to be understood that the terminology used herein is for the purpose of describing particular embodiments only, and is not intended to limit the scope of the present invention which will be limited only by the appended claims. As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

The term "proprotein convertase subtilisin kexin type 9" or "PCSK9" refers to a polypeptide as set forth in SEQ ID NO: 961 and/or SEQ ID NO: 962 or fragments thereof, as well as related polypeptides, which include, but are not limited to, allelic variants, splice variants, derivative variants, substitution variants, deletion variants, and/or insertion variants including the addition of an N-terminal methionine, fusion polypeptides, and interspecies homologs. In certain embodiments, a PCSK9 polypeptide includes terminal residues, such as, but not limited to, leader sequence residues, targeting residues, amino terminal methionine residues, lysine residues, tag residues, and/or fusion protein residues. "PCSK9" has also been referred to as FH3, NARC1, HCHOLA3, proprotein convertase subtilisin/kexin type 9, and neural apoptosis regulated convertase 1. The PCSK9 gene encodes a proprotein convertase protein that belongs to the proteinase K subfamily of the secretory subtilase family. The term "PCSK9" denotes both the proprotein (SEQ ID NO: 961) and the product generated following autocatalysis of the proprotein (SEQ ID NO: 962). When only the autocatalyzed product is being referred to (such as for an antibody or antibody fragment according to the invention that selectively binds to the cleaved PCSK9), the protein can be referred to as the "mature," "cleaved", "processed" or "active" PCSK9. When only the inactive form is being referred to, the protein can be referred to as the "inactive", "pro-form", or "unprocessed" form of PCSK9. The term PCSK9 as used herein also includes naturally occurring alleles, such as the mutations D374Y, S127R and F216L. The term PCSK9 also encompasses PCSK9 molecules incorporating post-translational modifications of the PCSK9 amino acid sequence, such as PCSK9 sequences that have been glycosylated, PEGylated, PCSK9 sequences from which its signal sequence has been cleaved, PCSK9 sequence from which its pro domain has been cleaved from the catalytic domain but not separated from the catalytic domain.

The term "PCSK9 activity" includes any biological effect of PCSK9. In certain embodiments, PCSK9 activity includes the ability of PCSK9 to interact or bind to a substrate or receptor. In some embodiments, PCSK9 activity is represented by the ability of PCSK9 to bind to a LDL-R receptor (LDLR). In some embodiments, PCSK9 binds to and catalyzes a reaction involving LDLR. In some embodiments, PCSK9 activity includes the ability of PCSK9 to alter (e.g., reduce) the availability of LDLR. In some embodiments, PCSK9 activity includes the ability of PCSK9 to increase the amount of LDL-C in a subject. In some embodiments, PCSK9 activity includes the ability of PCSK9 to decrease the amount of LDLR that is available to bind to LDL. In some embodiments, "PCSK9 activity" includes any biological activity resulting from PCSK9 signaling. Exemplary activities include, but are not limited to, PCSK9 binding to LDLR, PCSK9 enzyme activity that cleaves LDLR or other proteins, PCSK9 binding to proteins other than LDLR that facilitate PCSK9 action, PCSK9 altering APOB secretion (Sun X-M et al, "Evidence for effect of mutant PCSK9 on apolipoprotein B secretion as the cause of unusually severe dominant hypercholesterolemia, Human Molecular Genetics 14: 1161-1169, 2005 and Ouguerram K et al, "Apolipoprotein B100 metabolism in autosomal-dominant hypercholesterolemia related to mutations in PCSK9, Arterioscler Thromb Vasc Biol. 24: 1448-1453, 2004), PCSK9's role in liver regeneration and neuronal cell differentiation (Seidah N G et al, "The secretory proprotein convertase neural apoptosis-regulated convertase 1 (NARC-1): Liver regeneration and neuronal differentiation" PNAS 100: 928-933, 2003), and PCSK9's role in hepatic glucose metabolism (Costet et al., "Hepatic PCSK9 expression is regulated by nutritional status via insulin and sterol regulatory element-binding protein 1c" J. Biol. Chem. 281(10):6211-18, 2006).

The term "hypercholesterolemia," as used herein, refers to a condition in which cholesterol levels are elevated above a desired level. In some embodiments, this denotes that serum cholesterol levels are elevated. In some embodiments, the desired level takes into account various "risk factors" that are known to one of skill in the art (and are described or referenced herein).

The term "Recombinant cell" or "recombinant host cell" herein in general refers to any cell engineered to express one or more antibody polypeptides according to the invention. This includes by way of example bacterial, fungal, yeast, mammalian, invertebrate such as insect, plant and avian cells. Preferred host cells are yeast, fungi, especially filamentous fungi and mammalian cells. Yeast and filamentous fungi include, but are not limited to *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia sp., Saccharomyces cerevisiae, Saccharomyces sp., Hansenula polymorpha, Kluyveromyces sp., Kluyveromyces lactis, Candida albicans, Aspergillus nidulans, Aspergillus niger, Aspergillus oryzae, Trichoderma reesei, Chrysosporium lucknowense, Fusarium sp., Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa*.

Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/−DHFR(CHO, Urlaub and Chasin, Proc. Natl. Acad. Sci. USA, 77:4216 (1980)); mouse sertoli cells (TM4, Mather, Biol. Reprod., 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art. Preferred mammalian cells for antibody expression include CHO cells and COS cells. In an exemplary embodiment the recombinant host cells are polyploidal yeast cells of the genus *Pichia*.

Mating Competent Yeast Species:

In the present invention this is intended to broadly encompass any diploid or tetraploid yeast which can be grown in culture. Such species of yeast may exist in a haploid, diploid, or other polyploid form. The cells of a given ploidy may, under appropriate conditions, proliferate for an indefinite number of generations in that form. Diploid cells can also sporulate to form haploid cells. Sequential mating can result in tetraploid strains through further mating or fusion of diploid strains. The present invention contemplates the use of haploid yeast, as well as diploid or other polyploid yeast cells produced, for example, by mating or spheroplast fusion.

Mating competent yeast include yeast which are a member of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis*; and *Zygosaccharomyces*. Other types of yeast potentially useful in the invention include *Yarrowia; Rhodosporidium; Candida; Hansenula; Filobasium; Sporidiobolus; Bullera; Leucosporidium* and *Filobasidella*.

In a preferred embodiment of the invention, the mating competent yeast is a member of the genus *Pichia*. In a further preferred embodiment of the invention, the mating competent yeast of the genus *Pichia* is one of the following species: *Pichia pastoris, Pichia methanolica*, and *Hansenula polymorphs (Pichia angusta)*. In a particularly preferred embodiment of the invention, the mating competent yeast of the genus *Pichia* is the species *Pichia pastoris*.

Haploid Yeast Cell:
A cell having a single copy of each gene of its normal genomic (chromosomal) complement.

Polyploid Yeast Cell:
A cell having more than one copy of its normal genomic (chromosomal) complement.

Diploid Yeast Cell:
A cell having two copies (alleles) of essentially every gene of its normal genomic complement, typically formed by the process of fusion (mating) of two haploid cells.

Tetraploid Yeast Cell:
A cell having four copies (alleles) of essentially every gene of its normal genomic complement, typically formed by the process of fusion (mating) of two haploid cells. Tetraploids may carry two, three, four or more different expression cassettes. Such tetraploids might be obtained in *S. cerevisiae* by selective mating homozygotic heterothallic a/a and alpha/alpha diploids and in *Pichia* by sequential mating of haploids to obtain auxotrophic diploids. For example, a [met his] haploid can be mated with [ade his] haploid to obtain diploid [his]; and a [met arg] haploid can be mated with [ade arg] haploid to obtain diploid [arg]; then the diploid [his]×diploid [arg] to obtain a tetraploid prototroph. It will be understood by those of skill in the art that reference to the benefits and uses of diploid cells may also apply to tetraploid cells.

Yeast Mating:
The process by which two haploid yeast cells naturally fuse to form one diploid yeast cell.

Meiosis:
The process by which a diploid yeast cell undergoes reductive division to form four haploid spore products. Each spore may then germinate and form a haploid vegetatively growing cell line.

Selectable Marker:
A selectable marker is a gene or gene fragment that confers a growth phenotype (physical growth characteristic) on a cell receiving that gene as, for example through a transformation event. The selectable marker allows that cell to survive and grow in a selective growth medium under conditions in which cells that do not receive that selectable marker gene cannot grow. Selectable marker genes generally fall into several types, including positive selectable marker genes such as a gene that confers on a cell resistance to an antibiotic or other drug, temperature when two temperature sensitive ("ts") mutants are crossed or a is mutant is transformed; negative selectable marker genes such as a biosynthetic gene that confers on a cell the ability to grow in a medium without a specific nutrient needed by all cells that do not have that biosynthetic gene, or a mutagenized biosynthetic gene that confers on a cell inability to grow by cells that do not have the wild type gene; and the like. Suitable markers include but are not limited to: ZEO; G418; LYS3; MET1; MET3a; ADE1; ADE3; URA3; and the like.

Expression Vector:
These DNA vectors contain elements that facilitate manipulation for the expression of a foreign protein within the target host cell. Conveniently, manipulation of sequences and production of DNA for transformation is first performed in a bacterial host, e.g. *E. coli*, and usually vectors will include sequences to facilitate such manipulations, including a bacterial origin of replication and appropriate bacterial selection marker. Selection markers encode proteins necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, (b) complement auxotrophic deficiencies, or (c) supply critical nutrients not available from complex media. Exemplary vectors and methods for transformation of yeast are described, for example, in Burke, D., Dawson, D., & Stearns, T. (2000). Methods in yeast genetics: a Cold Spring Harbor Laboratory course manual. Plainview, N.Y.: Cold Spring Harbor Laboratory Press.

Expression vectors for use in the methods of the invention will further include yeast specific sequences, including a selectable auxotrophic or drug marker for identifying transformed yeast strains. A drug marker may further be used to amplify copy number of the vector in a yeast host cell.

The polypeptide coding sequence of interest is operably linked to transcriptional and translational regulatory sequences that provide for expression of the polypeptide in yeast cells. These vector components may include, but are not limited to, one or more of the following: an enhancer element, a promoter, and a transcription termination sequence. Sequences for the secretion of the polypeptide may also be included, e.g. a signal sequence, and the like. A yeast origin of replication is optional, as expression vectors are often integrated into the yeast genome. In one embodiment of the invention, the polypeptide of interest is operably linked, or fused, to sequences providing for optimized secretion of the polypeptide from yeast diploid cells.

Nucleic acids are "operably linked" when placed into a functional relationship with another nucleic acid sequence. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites or alternatively via a PCR/recombination method familiar to those skilled in the art (Gateway® Technology; Invitrogen, Carlsbad Calif.). If such sites do not exist, the synthetic oligonucleotide adapters or linkers are used in accordance with conventional practice.

Promoters are untranslated sequences located upstream (5') to the start codon of a structural gene (generally within about 100 to 1000 bp) that control the transcription and translation of particular nucleic acid sequences to which they are operably linked. Such promoters fall into several classes: inducible, constitutive, and repressible promoters (that increase levels of transcription in response to absence of a repressor). Inducible promoters may initiate increased levels of transcription from DNA under their control in response to some change in culture conditions, e.g., the presence or absence of a nutrient or a change in temperature.

The promoter fragment may also serve as the site for homologous recombination and integration of the expression vector into the same site in the host genome; alternatively a selectable marker is used as the site for homologous recombination.

Examples of suitable promoters useful in *Pichia* include the AOX1 and promoter (Cregg et al. (1989) *Mol. Cell. Biol.* 9:1316-1323); ICL1 promoter (Menendez et al. (2003) *Yeast* 20(13): 1097-108); glyceraldehyde-3-phosphate dehydrogenase promoter (GAP) (Waterham et al. (1997) *Gene* 186(1): 37-44); and FLD1 promoter (Shen et al. (1998) *Gene* 216(1): 93-102). The GAP promoter is a strong constitutive promoter and the AOX and FLD1 promoters are inducible.

Other yeast promoters include ADH1, alcohol dehydrogenase II, GAL4, PHO3, PHO5, Pyk, and chimeric promoters derived therefrom. Additionally, non-yeast promoters may be used in the invention such as mammalian, insect, plant, reptile, amphibian, bacterial, fungal, viral, and avian promoters. Most typically the promoter will comprise a mammalian promoter (potentially endogenous to the expressed genes) or will comprise a yeast or viral promoter that provides for efficient transcription in yeast systems.

The polypeptides of interest may be produced recombinantly not only directly, but also as a fusion polypeptide with a heterologous polypeptide, e.g. a signal sequence or other polypeptide having a specific cleavage site at the N-terminus of the mature protein or polypeptide. In general, the signal sequence may be a component of the vector, or it may be a part of the polypeptide coding sequence that is inserted into the vector. The heterologous signal sequence selected preferably is one that is recognized and processed through one of the standard pathways available within the host cell. The *S. cerevisiae* alpha factor pre-pro signal has proven effective in the secretion of a variety of recombinant proteins from *P. pastoris*. Other yeast signal sequences include the alpha mating factor signal sequence, the invertase signal sequence, and signal sequences derived from other secreted yeast polypeptides. Additionally, these signal peptide sequences may be engineered to provide for enhanced secretion in diploid yeast expression systems. Other secretion signals of interest also include mammalian signal sequences, which may be heterologous to the protein being secreted, or may be a native sequence for the protein being secreted. Signal sequences include pre-peptide sequences, and in some instances may include propeptide sequences. Many such signal sequences are known in the art, including the signal sequences found on immunoglobulin chains, e.g., K28 preprotoxin sequence, PHA-E, FACE, human MCP-1, human serum albumin signal sequences, human Ig heavy chain, human Ig light chain, and the like. For example, see Hashimoto et. al. Protein Eng 11(2) 75 (1998); and Kobayashi et. al. Therapeutic Apheresis 2(4) 257 (1998).

Transcription may be increased by inserting a transcriptional activator sequence into the vector. These activators are cis-acting elements of DNA, usually about from 10 to 300 bp, which act on a promoter to increase its transcription. Transcriptional enhancers are relatively orientation and position independent, having been found 5' and 3' to the transcription unit, within an intron, as well as within the coding sequence itself. The enhancer may be spliced into the expression vector at a position 5' or 3' to the coding sequence, but is preferably located at a site 5' from the promoter.

Expression vectors used in eukaryotic host cells may also contain sequences necessary for the termination of transcription and for stabilizing the mRNA. Such sequences are commonly available from 3' to the translation termination codon, in untranslated regions of eukaryotic or viral DNAs or cDNAs. These regions contain nucleotide segments transcribed as polyadenylated fragments in the untranslated portion of the mRNA.

Construction of suitable vectors containing one or more of the above-listed components employs standard ligation techniques or PCR/recombination methods. Isolated plasmids or DNA fragments are cleaved, tailored, and re-ligated in the form desired to generate the plasmids required or via recombination methods. For analysis to confirm correct sequences in plasmids constructed, the ligation mixtures are used to transform host cells, and successful transformants selected by antibiotic resistance (e.g. ampicillin or Zeocin) where appropriate. Plasmids from the transformants are prepared, analyzed by restriction endonuclease digestion and/or sequenced.

As an alternative to restriction and ligation of fragments, recombination methods based on att sites and recombination enzymes may be used to insert DNA sequences into a vector. Such methods are described, for example, by Landy (1989) Ann. Rev. Biochem. 58:913-949; and are known to those of skill in the art. Such methods utilize intermolecular DNA recombination that is mediated by a mixture of lambda and *E. coli*-encoded recombination proteins. Recombination occurs between specific attachment (att) sites on the interacting DNA molecules. For a description of att sites see Weisberg and Landy (1983) Site-Specific Recombination in Phage Lambda, in *Lambda II*, Weisberg, ed. (Cold Spring Harbor, N.Y.: Cold Spring Harbor Press), pp. 211-250. The DNA segments flanking the recombination sites are switched, such that after recombination, the att sites are hybrid sequences comprised of sequences donated by each parental vector. The recombination can occur between DNAs of any topology.

Att sites may be introduced into a sequence of interest by ligating the sequence of interest into an appropriate vector; generating a PCR product containing att B sites through the use of specific primers; generating a cDNA library cloned into an appropriate vector containing att sites; and the like.

Folding, as used herein, refers to the three-dimensional structure of polypeptides and proteins, where interactions between amino acid residues act to stabilize the structure. While non-covalent interactions are important in determining structure, usually the proteins of interest will have intra- and/or intermolecular covalent disulfide bonds formed by two cysteine residues. For naturally occurring proteins and polypeptides or derivatives and variants thereof, the proper folding is typically the arrangement that results in optimal biological activity, and can conveniently be monitored by assays for activity, e.g. ligand binding, enzymatic activity, etc.

In some instances, for example where the desired product is of synthetic origin, assays based on biological activity will be less meaningful. The proper folding of such molecules may be determined on the basis of physical properties, energetic considerations, modeling studies, and the like.

The expression host may be further modified by the introduction of sequences encoding one or more enzymes that enhance folding and disulfide bond formation, i.e. foldases, chaperonins, etc. Such sequences may be constitutively or inducibly expressed in the yeast host cell, using vectors, markers, etc. as known in the art. Preferably the sequences, including transcriptional regulatory elements sufficient for the desired pattern of expression, are stably integrated in the yeast genome through a targeted methodology.

For example, the eukaryotic PDI is not only an efficient catalyst of protein cysteine oxidation and disulfide bond isomerization, but also exhibits chaperone activity. Co-expression of PDI can facilitate the production of active proteins having multiple disulfide bonds. Also of interest is the expression of BIP (immunoglobulin heavy chain binding protein); cyclophilin; and the like. In one embodiment of the invention, each of the haploid parental strains expresses a distinct folding enzyme, e.g. one strain may express BIP, and the other strain may express PDI or combinations thereof.

The terms "desired protein" or "desired antibody" are used interchangeably and refer generally to a parent antibody or fragment specific to a target, i.e., PCSK9 or a chimeric or humanized antibody or a binding portion thereof derived therefrom or one containing the same CDRs or epitopic specificity as any of the anti-PCSK9 antibodies or fragments described herein. The term "antibody" is intended to include any polypeptide chain-containing molecular structure with a specific shape that fits to and recognizes an epitope, where one or more non-covalent binding interactions stabilize the complex between the molecular structure and the epitope. The archetypal antibody molecule is the immunoglobulin, and all types of immunoglobulins, IgG, IgM, IgA, IgE, IgD, etc., from all sources, e.g. human, rodent, rabbit, cow, sheep, pig, dog, other mammals, chicken, other avians, etc., are considered to be "antibodies." A preferred source for producing antibodies useful as starting material according to the invention is rabbits. Numerous antibody coding sequences have been described; and others may be raised by methods well-known in the art. Examples thereof include chimeric antibodies, human antibodies and other non-human mammalian antibodies, humanized antibodies, single chain antibodies (such as scFvs), camelbodies, nanobodies, IgNAR (single-chain antibodies derived from sharks), small-modular immunopharmaceuticals (SMIPs), and antibody fragments such as Fabs, Fab', F(ab')$_2$, monovalent antibody fragments such as MetMab like molecules, IgNars and the like. See Streltsov V A, et al., Structure of a shark IgNAR antibody variable domain and modeling of an early-developmental isotype, Protein Sci. 2005 November; 14(11):2901-9. Epub 2005 Sep. 30; Greenberg A S, et al., A new antigen receptor gene family that undergoes rearrangement and extensive somatic diversification in sharks, Nature. 1995 Mar. 9; 374 (6518):168-73; Nuttall S D, et al., Isolation of the new antigen receptor from wobbegong sharks, and use as a scaffold for the display of protein loop libraries, Mol. Immunol. 2001 August; 38(4):313-26; Hamers-Casterman C, et al., Naturally occurring antibodies devoid of light chains, Nature. 1993 Jun. 3; 363(6428):446-8; Gill D S, et al., Biopharmaceutical drug discovery using novel protein scaffolds, Curr Opin Biotechnol. 2006 December; 17(6):653-8. Epub 2006 Oct. 19.

The present invention includes in particular includes monovalent antibody molecules that bind PCSK9, which are analogous to MetMab molecules. MetMab is a monovalent antibody specific to Met. (Met is a protein encoded by the nucleotide sequence set forth in Park et al., Proc. Natl. Acad. Sci. 84, 7479—(1987), or fragments thereof, as well as related polypeptides, which include, but are not limited to, allelic variants, splice variants, derivative variants, substitution variants, deletion variants, and/or insertion variants, fusion polypeptides, and interspecies homologs). The MetMab antibody, is a monovalent antibody known by different names including OA-5d5 (Genentech) and is also called One Armed 5d5, 5d5, MetMab, PRO143966, among others). Antibody OA-5d5, including its structure and properties, and methods for making and using it, are described in U.S. Publication No. 2007/0092520. In one embodiment, an anti-PCSK9 antibody according to the invention may comprise a single Fab region linked to an Fc region. In such embodiment, an antibody of the invention may comprise light and heavy chain variable domains as described herein. In such an embodiment, the antibody is monovalent and may comprise an intact Fc region. In another such embodiment, the Fc region may comprise at least one protuberance (knob) and at least one cavity (hole), wherein the presence of the protuberance and cavity enhances formation of a complex between an Fc polypeptide comprising the protuberance and an Fc polypeptide comprising the cavity, for example as described in WO 2005/063816. In one embodiment, the Fc region of an antibody of the invention may comprise a first and a second Fc polypeptide, wherein the first and second polypeptide each comprises one or more mutations with respect to wild type human Fc. In one embodiment, a cavity mutation is T366S, L368A and/or Y407V. In another embodiment, a protuberance mutation is T366W. In a specific embodiment, a monovalent antibody according to the subject invention may comprise a one-armed antibody synthesized as described in WO2005/063816. In such embodiment, the one-armed antibody may comprise Fc mutations constituting "knobs" and "holes" as described in WO2005/063816. For example, a hole mutation can be one or more of T366A, L368A and/or Y407V in an Fc polypeptide, and a cavity mutation can be T366W. The invention is also directed to an anti-human PCSK9 monovalent agent that binds with the same PCSK9 epitope and/or competes with an anti-PCSK9 antibody for binding to PCSK9 as an antibody or antibody fragment disclosed herein.

For example, antibodies or antigen binding fragments may be produced by genetic engineering. In this technique, as with other methods, antibody-producing cells are sensitized to the desired antigen or immunogen. The messenger RNA isolated from antibody producing cells is used as a template to make cDNA using PCR amplification. A library of vectors, each containing one heavy chain gene and one light chain gene retaining the initial antigen specificity, is produced by insertion of appropriate sections of the amplified immunoglobulin cDNA into the expression vectors. A combinatorial library is constructed by combining the heavy chain gene library with the light chain gene library. This results in a library of clones which co-express a heavy and light chain (resembling the Fab fragment or antigen binding fragment of an antibody molecule). The vectors that carry these genes are co-transfected into a host cell. When antibody gene synthesis is induced in the transfected host, the heavy and light chain proteins self-assemble to produce active antibodies that can be detected by screening with the antigen or immunogen.

Antibody coding sequences of interest include those encoded by native sequences, as well as nucleic acids that, by virtue of the degeneracy of the genetic code, are not identical in sequence to the disclosed nucleic acids, and variants thereof. Variant polypeptides can include amino acid (aa) substitutions, additions or deletions. The amino acid substitutions can be conservative amino acid substitutions or substitutions to eliminate non-essential amino acids, such as to alter a glycosylation site, or to minimize misfolding by substitution or deletion of one or more cysteine residues that are not necessary for function. Variants can be designed so as to retain or have enhanced biological activity of a particular region of the protein (e.g., a functional domain, catalytic amino acid residues, etc). Variants also include fragments of the polypeptides disclosed herein, particularly biologically active fragments and/or fragments corresponding to functional domains. Techniques for in vitro mutagenesis of cloned genes are known. Also included in the subject invention are polypeptides that have been modified using ordinary molecular biological techniques so as to improve their resistance to proteolytic degradation or to optimize solubility properties or to render them more suitable as a therapeutic agent.

Chimeric antibodies may be made by recombinant means by combining the variable light and heavy chain regions ($V_L$ and $V_H$), obtained from antibody producing cells of one species with the constant light and heavy chain regions from another. Typically chimeric antibodies utilize rodent or rabbit variable regions and human constant regions, in order to produce an antibody with predominantly human domains. The production of such chimeric antibodies is well known in the art, and may be achieved by standard means (as described, e.g., in U.S. Pat. No. 5,624,659, incorporated herein by reference in its entirety). It is further contemplated that the human constant regions of chimeric antibodies of the invention may be selected from IgG1, IgG2, IgG3, and IgG4 constant regions.

Humanized antibodies are engineered to contain even more human-like immunoglobulin domains, and incorporate only the complementarity-determining regions of the animal-derived antibody. This is accomplished by carefully examining the sequence of the hyper-variable loops of the variable regions of the monoclonal antibody, and fitting them to the structure of the human antibody chains. Although facially complex, the process is straightforward in practice. See, e.g., U.S. Pat. No. 6,187,287, incorporated fully herein by reference.

In addition to entire immunoglobulins (or their recombinant counterparts), immunoglobulin fragments comprising the epitope binding site (e.g., Fab', F(ab')$_2$, Fab, or other fragments) may be synthesized. "Fragment" or minimal immunoglobulins may be designed utilizing recombinant immunoglobulin techniques. For instance "Fv" immunoglobulins for use in the present invention may be produced by synthesizing a fused variable light chain region and a variable heavy chain region. Combinations of antibodies are also of interest, e.g. diabodies, which comprise two distinct Fv specificities. In another embodiment of the invention, SMIPs (small molecule immunopharmaceuticals), camelbodies, nanobodies, and IgNAR are encompassed by immunoglobulin fragments.

Immunoglobulins and fragments thereof may be modified post-translationally, e.g. to add effector moieties such as chemical linkers, detectable moieties, such as fluorescent dyes, enzymes, toxins, substrates, bioluminescent materials, radioactive materials, chemiluminescent moieties and the like, or specific binding moieties, such as streptavidin, avidin, or biotin, and the like may be utilized in the methods and compositions of the present invention. Examples of additional effector molecules are provided infra.

A polynucleotide sequence "corresponds" to a polypeptide sequence if translation of the polynucleotide sequence in accordance with the genetic code yields the polypeptide sequence (i.e., the polynucleotide sequence "encodes" the polypeptide sequence), one polynucleotide sequence "corresponds" to another polynucleotide sequence if the two sequences encode the same polypeptide sequence.

A "heterologous" region or domain of a DNA construct is an identifiable segment of DNA within a larger DNA molecule that is not found in association with the larger molecule in nature. Thus, when the heterologous region encodes a mammalian gene, the gene will usually be flanked by DNA that does not flank the mammalian genomic DNA in the genome of the source organism. Another example of a heterologous region is a construct where the coding sequence itself is not found in nature (e.g., a cDNA where the genomic coding sequence contains introns, or synthetic sequences having codons different than the native gene). Allelic variations or naturally-occurring mutational events do not give rise to a heterologous region of DNA as defined herein.

A "coding sequence" is an in-frame sequence of codons that (in view of the genetic code) correspond to or encode a protein or peptide sequence. Two coding sequences correspond to each other if the sequences or their complementary sequences encode the same amino acid sequences. A coding sequence in association with appropriate regulatory sequences may be transcribed and translated into a polypeptide. A polyadenylation signal and transcription termination sequence will usually be located 3' to the coding sequence. A "promoter sequence" is a DNA regulatory region capable of binding RNA polymerase in a cell and initiating transcription of a downstream (3' direction) coding sequence. Promoter sequences typically contain additional sites for binding of regulatory molecules (e.g., transcription factors) which affect the transcription of the coding sequence. A coding sequence is "under the control" of the promoter sequence or "operatively linked" to the promoter when RNA polymerase binds the promoter sequence in a cell and transcribes the coding sequence into mRNA, which is then in turn translated into the protein encoded by the coding sequence.

Vectors are used to introduce a foreign substance, such as DNA, RNA or protein, into an organism or host cell. Typical vectors include recombinant viruses (for polynucleotides) and liposomes (for polypeptides). A "DNA vector" is a replicon, such as plasmid, phage or cosmid, to which another polynucleotide segment may be attached so as to bring about the replication of the attached segment. An "expression vector" is a DNA vector which contains regulatory sequences which will direct polypeptide synthesis by an appropriate host cell. This usually means a promoter to bind RNA polymerase and initiate transcription of mRNA, as well as ribosome binding sites and initiation signals to direct translation of the mRNA into a polypeptide(s). Incorporation of a polynucleotide sequence into an expression vector at the proper site and in correct reading frame, followed by transformation of an appropriate host cell by the vector, enables the production of a polypeptide encoded by said polynucleotide sequence.

"Amplification" of polynucleotide sequences is the in vitro production of multiple copies of a particular nucleic acid sequence. The amplified sequence is usually in the form of DNA. A variety of techniques for carrying out such amplification are described in a review article by Van Brunt (1990, Bio/Technol., 8(4):291-294). Polymerase chain reaction or PCR is a prototype of nucleic acid amplification, and use of PCR herein should be considered exemplary of other suitable amplification techniques.

The general structure of antibodies in vertebrates now is well understood (Edelman, G. M., Ann. N.Y. Acad. Sci., 190: 5 (1971)). Antibodies consist of two identical light polypeptide chains of molecular weight approximately 23,000 Daltons (the "light chain"), and two identical heavy chains of molecular weight 53,000-70,000 (the "heavy chain"). The four chains are joined by disulfide bonds in a "Y" configuration wherein the light chains bracket the heavy chains starting at the mouth of the "Y" configuration. The "branch" portion of the "Y" configuration is designated the $F_{ab}$ region; the stem portion of the "Y" configuration is designated the $F_c$ region. The amino acid sequence orientation runs from the N-terminal end at the top of the "Y" configuration to the C-terminal end at the bottom of each chain. The N-terminal end possesses the variable region having specificity for the antigen that elicited it, and is approximately 100 amino acids in length, there being slight variations between light and heavy chain and from antibody to antibody.

The variable region is linked in each chain to a constant region that extends the remaining length of the chain and that within a particular class of antibody does not vary with the specificity of the antibody (i.e., the antigen eliciting it). There are five known major classes of constant regions that determine the class of the immunoglobulin molecule (IgG, IgM, IgA, IgD, and IgE corresponding to $\gamma$, $\mu$, $\alpha$, $\delta$, and $\epsilon$ (gamma, mu, alpha, delta, or epsilon) heavy chain constant regions). The constant region or class determines subsequent effector function of the antibody, including activation of complement (Kabat, E. A., Structural Concepts in Immunology and Immunochemistry, 2nd Ed., p. 413-436, Holt, Rinehart, Winston (1976)), and other cellular responses (Andrews, D. W., et al., Clinical Immunobiology, pp 1-18, W. B. Sanders (1980); Kohl, S., et al., Immunology, 48: 187 (1983)); while the variable region determines the antigen with which it will react. Light chains are classified as either $\kappa$ (kappa) or $\lambda$ (lambda). Each heavy chain class can be prepared with either kappa or lambda light chain. The light and heavy chains are covalently bonded to each other, and the "tail" portions of the two heavy chains are bonded to each other by covalent disulfide linkages when the immunoglobulins are generated either by hybridomas or by B cells.

The expression "variable region" or "VR" refers to the domains within each pair of light and heavy chains in an antibody that are involved directly in binding the antibody to the antigen. Each heavy chain has at one end a variable domain ($V_H$) followed by a number of constant domains. Each light chain has a variable domain ($V_L$) at one end and a constant domain at its other end; the constant domain of the light chain is aligned with the first constant domain of the heavy chain, and the light chain variable domain is aligned with the variable domain of the heavy chain.

The expressions "complementarity determining region," "hypervariable region," or "CDR" refer to one or more of the hyper-variable or complementarity determining regions (CDRs) found in the variable regions of light or heavy chains of an antibody (See Kabat, E. A. et al., Sequences of Proteins of Immunological Interest, National Institutes of Health, Bethesda, Md., (1987)). These expressions include the hypervariable regions as defined by Kabat et al. ("Sequences of Proteins of Immunological Interest," Kabat E., et al., US Dept. of Health and Human Services, 1983) or the hypervariable loops in 3-dimensional structures of antibodies (Chothia and Lesk, J. Mol. Biol. 196 901-917 (1987)). The CDRs in each chain are held in close proximity by framework regions and, with the CDRs from the other chain, contribute to the formation of the antigen binding site. Within the CDRs there are select amino acids that have been described as the selectivity determining regions (SDRs) which represent the critical contact residues used by the CDR in the antibody-antigen interaction (Kashmiri, S., Methods, 36:25-34 (2005)).

An "epitope" or "binding site" is an area or region on an antigen to which an antigen-binding peptide (such as an antibody) specifically binds. A protein epitope may comprise amino acid residues directly involved in the binding (also called immunodominant component of the epitope) and other amino acid residues, which are not directly involved in the binding, such as amino acid residues which are effectively blocked by the specifically antigen binding peptide (in other words, the amino acid residue is within the "footprint" of the specifically antigen binding peptide). The term epitope herein includes both types of amino acid binding sites in any particular region of PCSK9 that specifically binds to an anti-PCSK9 antibody. PCSK9 may comprise a number of different epitopes, which may include, without limitation, (1) linear peptide antigenic determinants, (2) conformational antigenic determinants which consist of one or more non-contiguous amino acids located near each other in a mature PCSK9 conformation; and (3) post-translational antigenic determinants which consist, either in whole or part, of molecular structures covalently attached to a PCSK9 protein such as carbohydrate groups.

The phrase that a first antibody binds "substantially" or "at least partially" the same epitope as a second antibody means that the epitope binding site for the first antibody comprises at least 10%, 20%, 30%, 40%, 50%, 60%, 70%, 80%, 90%, or more of the amino acid residues on the antigen that constitutes the epitope binding site of the second antibody. Also, that a first antibody binds substantially or partially the same or overlapping epitope as a second antibody means that the first and second antibodies compete in binding to the antigen, as described above. Thus, the term "binds to substantially the same epitope or determinant as" a monoclonal antibody means that an antibody "competes" with the antibody.

The phrase "binds to the same or overlapping epitope or determinant as" an antibody of interest means that an antibody "competes" with said antibody of interest for at least one, or all residues on PCSK9 to which said antibody of interest specifically binds. The identification of one or more antibodies that bind(s) to substantially or essentially the same epitope as the monoclonal antibodies described herein can be readily determined using any one of variety of immunological screening assays in which antibody competition can be assessed. A number of such assays are routinely practiced and well known in the art (see, e.g., U.S. Pat. No. 5,660,827, issued Aug. 26, 1997, which is specifically incorporated herein by reference). It will be understood that actually determining the epitope to which an antibody described herein binds is not in any way required to identify an antibody that binds to the same or substantially the same or overlapping epitope as the monoclonal antibody described herein.

For example, where the test antibodies to be examined are obtained from different source animals, or are even of a different Ig isotype, a simple competition assay may be employed in which the control antibody is mixed with the test antibody and then applied to a sample containing PCSK9. Protocols based upon ELISAs, radioimmunoassays, Western blotting, and the use of BIACORE analysis are suitable for use in such simple competition studies.

In certain embodiments, one would pre-mix the control anti-PCSK9 antibody with varying amounts of the test antibody (e.g., in ratios of about 1:1, 1:2, 1:10 or about 1:100) for a period of time prior to applying to the PCSK9 antigen sample. In other embodiments, the control and varying amounts of test antibody can simply be added separately and admixed during exposure to the PCSK9 antigen sample. As long as one can distinguish bound from free antibodies (e.g., by using separation or washing techniques to eliminate unbound antibodies) and control antibody from the test antibody (e.g., by using species specific or isotype specific secondary antibodies or by specifically labeling the control antibody with a detectable label) one will be able to determine if the test antibody reduces the binding of the control antibody to the PCSK9 antigens, indicating that the test antibody recognizes substantially the same epitope as the control ant- PCSK9 antibody. The binding of the (labeled) control antibody in the presence of a completely irrelevant antibody (that does not bind PCSK9) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of the control antibody to PCSK9 s by at least about 50%, such as at least about 60%, or more preferably at least about 70% (e.g., about 65-100%), at any ratio of: test antibody between about 1:1 or 1:10 and about 1:100 is considered to be an antibody that binds to substantially the same or overlapping epitope or determinant as the control antibody.

Preferably, such test antibody will reduce the binding of the control antibody to PCSK9 antigen preferably at least about 50%, at least about 60%, at least about 80% or at least about 90% (e.g., about 95%) of the binding of 1 the control antibody observed in the absence of the test antibody.

Competition can also or alternatively be assessed by, for example, a flow cytometry test. In such a test, cells bearing PCSK9 can be incubated first with a control antibody that binds PCSK9, and then with the test antibody labeled with a fluorochrome or biotin. The antibody is said to compete with control antibody if the binding obtained upon preincubation with saturating amount of control antibody is about 80%, preferably about 50%, about 40% or less (e.g., about 30%) of the binding (as measured by mean of fluorescence) obtained by the test antibody without preincubation with control antibody. Alternatively, an antibody is said to compete with the control antibody if the binding obtained with a labeled control antibody (by a fluorochrome or biotin) on cells preincubated with saturating amount of test antibody is about 80%, preferably about 50%, about 40%, or less (e.g., about 30%) of the binding obtained without preincubation with the test antibody.

A simple competition assay in which a test antibody is pre-adsorbed and applied at saturating concentration to a surface onto which PCSK9 is immobilized also may be advantageously employed. The surface in the simple competition assay is preferably a BIACORE chip (or other media suitable for surface plasmon resonance analysis). The binding of a control antibody that binds PCSK9 to the PCSK9-coated surface is measured. This binding to the PCSK9-containing surface of the control antibody alone is compared with the binding of the control antibody in the presence of a test antibody. A significant reduction in binding to the PCSK9-containing surface by the control antibody in the presence of a test antibody indicates that the test antibody recognizes substantially the same epitope as the control antibody such that the test antibody "competes" with the control antibody. Any test antibody that reduces the binding of control antibody by at least about 20% or more, at least about 40%, at least about 50%, at least about 70%, or more, can be considered to be an antibody that binds to substantially the same epitope or determinant as the control antibody. Preferably, such test antibody will reduce the binding of the control antibody to PCSK9 by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the antibody having higher affinity for PCSK9 antigen is bound to the PCSK9-containing surface first, as it will be expected that the decrease in binding seen for the second antibody (assuming the antibodies are competing) will be of greater magnitude. Further examples of such assays are provided in e.g., Saunal and Regenmortel, (1995) J. Immunol. Methods 183: 33-41, the disclosure of which is incorporated herein by reference.

In addition, whether an antibody binds the same or overlapping epitope(s) on PCSK9 as another antibody or the epitope bound by a test antibody may in particular be determined using a western-blot based assay. In this assay a library of peptides corresponding to the antigen bound by the antibody, herein PCSK9 is made, which correspond to overlapping portions of the protein, typically 10-25, 10-20 or 10-15 amino acids long. These different overlapping amino acid peptides encompassing the PCSK9 sequence are synthesized and covalently bound to a PepSpots nitrocellulose membrane (JPT Peptide technologies, Berlin, Germany). Blots are then prepared and probed according to the manufacturer's recommendations.

Essentially, the immunoblot assay then detects by fluorimetric means what peptides in the library bind to the test antibody and thereby can identify what residues on the antigen, i.e., PCSK9, interact with the test antibody. (See an embodiment of this technique in U.S. Pat. No. 7,935,340, incorporated by reference herein).

The expressions "framework region" or "FR" refer to one or more of the framework regions within the variable regions of the light and heavy chains of an antibody (See Kabat, E. A. et al., Sequences of Proteins of Immunological Interest, National Institutes of Health, Bethesda, Md., (1987)). These expressions include those amino acid sequence regions interposed between the CDRs within the variable regions of the light and heavy chains of an antibody.

Anti-PCSK9 Antibodies and Binding Fragments Thereof Having Binding Activity for PCSK9

As mentioned in the Background of the invention, Proprotein convertase subtilisin kexin type 9 (PCSK9) is a serine protease involved in regulating the levels of the low density lipoprotein receptor (LDLR) protein (Horton et al., 32(2) *Trends Biochem. Sci.* 71-77 (2007); Seidah and Prat, 85(7) *J. Mol. Med.* 685-96 2007). PCSK9 is a prohormone-proprotein convertase in the subtilisin (S8) family of serine proteases Seidah et al., 100(3) *Proc. Nat'l Acad. Sci.* 928-33 (2003). Exemplary human PCSK9 amino acid sequences are presented as SEQ ID NO: 961 and SEQ ID NO: 962. An exemplary human PCSK9 coding sequence is presented as SEQ ID NO: 963. As described herein, PCSK9 proteins can also include fragments of the full length PCSK9 protein. The structure of the PCSK9 protein has recently been solved by two groups (Cunningham et al., Nature Structural & Molecular Biology, 2007, and Piper et al., Structure, 15:1-8, 2007), the entireties of both of which are herein incorporated by reference. PCSK9 includes a signal sequence, a N-terminal prodomain, a subtilisin-like catalytic domain, and a C-terminal domain.

The present invention provides novel antibodies or antibody fragments that bind PCSK9, including human PCSK9. In preferred embodiments, the antibody or antibody fragment according to the invention comprises one or more complementarity determining regions (CDRs), of the anti-PCSK9 antibodies and antibody fragments described herein.

In some embodiments, an anti-PCSK9 antibody or antibody fragment according to the invention will interfere with, block, reduce or modulate the interaction between PCSK9 and LDLR. In some instances an anti-PCSK9 antibody or antibody fragment according to the invention is denoted as "neutralizing", e.g., if it totally prevents the interaction of PCSK9 and LDLR. In some embodiments, the antibody or antibody fragment neutralizes PCSK9, e.g., by remaining bound to PCSK9. For example, in some embodiments, the antibody or antibody fragment according to the invention prevents or reduces the adverse influence of PCSK9 on LDLR without blocking the LDLR binding site on PCSK9. Thus, in some embodiments, the antibody or antibody fragment according to the invention modulates or alters PCSK9's ability to result in the degradation of LDLR, without having to prevent the binding interaction between PCSK9 and LDLR. More specifically, such an antibody or antibody fragment according to the invention can be specifically described as a "non-competitively neutralizing" antibody or antibody fragment. In some embodiments, the neutralizing antibody or antibody fragment according to the invention binds to PCSK9 in a location and/or manner that prevents PCSK9 from binding to LDLR. In some embodiments, the neutralizing antibody or antibody fragment according to the invention binds to PCSK9 in a location and/or manner that prevents endocytosis of the PCSK9/LDLR complex. Such antibody or antibody fragment according to the invention can be specifically described as "competitively neutralizing" antibody or antibody fragment according to the invention. All of the above neutralizing antibodies upon in vivo administration may result in a greater amount of free LDLR being present in a subject, which results in more LDLR binding to LDL-C (thereby reducing the amount of LDL-C in the subject). This in turn this results in a reduction in the amount of serum cholesterol present in a subject.

In some embodiments, the antibody or antibody fragment according to the invention are capable of inhibiting PCSK9-mediated activity (including binding). In some embodiments, the antibody or antibody fragment according to the invention are human, such as fully human antibodies to PCSK9.

In some embodiments, the antibody or antibody fragment according to the invention binds to the catalytic domain of PCSK9. In some embodiments, the antibody or antibody fragment according to the invention binds to the mature form of PCSK9. In some embodiments the antibody or antibody fragment according to the invention binds in the prodomain of PCSK9. In some embodiments, the antibody or antibody fragment according to the invention selectively binds to the mature form of PCSK9. In some embodiments, the antibody or antibody fragment according to the invention binds to the catalytic domain in a manner such that PCSK9 cannot bind or bind as efficiently to LDLR. In some embodiments, the antibody or antibody fragment according to the invention does not bind to the c-terminus of the catalytic domain. In some embodiments, the antibody or antibody fragment according to the invention does not bind to the n-terminus of the catalytic domain. In some embodiments, the antibody or antibody fragment according to the invention does not bind to the n- or c-terminus of the PCSK9 protein. In some embodiments, the antibody or antibody fragment according to the invention bind to a specific conformational state of PCSK9 so as to prevent PCSK9 from interacting with LDLR. In some embodiments, the antibody or antibody fragment according to the invention binds to the V domain of PCSK9. In some more specific embodiments, the antibody or antibody fragment according to the invention binds to the V domain of PCSK9 and prevents (or reduces) PCSK9 from binding to LDLR.

As mentioned, the anti-PCSK9 antibodies or antibody fragments according to the invention have a variety of utilities. For example, the subject antibodies and fragments are useful in therapeutic applications, as well as diagnostically in binding assays, and are useful for affinity purification of PCSK9, in particular human PCSK9 or its ligands and in screening assays to identify other antagonists of PCSK9 activity. Some of the antibodies or antibody fragments according to the invention are useful for inhibiting binding of PCSK9 to LDLR, or inhibiting PCSK9-mediated activities.

The antibody or antibody fragment according to the invention can be used in a variety of therapeutic applications. For example, in some embodiments the PCSK9 antibody or antibody fragment according to the invention are useful for treating conditions associated with PCSK9, such as cholesterol related disorders (or "serum cholesterol related disorders") including by way of example hypercholesterolemia, as further described herein.

The subject anti-PCSK9 antibodies and antibody fragments according to the invention can in particular be used for treating any subject wherein blocking, inhibiting or neutralizing the in vivo effect of PCSK9 or blocking or inhibiting the interaction of PCSK9 and LDLR is therapeutically desirable, wherein the subject anti-PCSK9 antibodies or antibody fragments may be used alone or in association with other active agents or drugs.

The subject anti-PCSK9 antibodies and antibody fragments according to the invention can also in particular be used for treating or preventing disorders of cholesterol or lipid homeostasis and disorders which may be associated therewith including by way of example hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, diabetes, obesity, angina, hypertension and xanthoma by the administration of the subject anti-PCSK9 antibodies and antibody fragments that specifically bind to PCSK9, wherein the subject antibodies and antibody fragments may be used alone or in association with other active agents.

The subject anti-PCSK9 antibodies and antibody fragments according to the invention can also in particular be used for preventing or treating diseases and disorders associated with PCSK9, e.g., diseases associated with increased or decreased levels of PCSK9 and/or mutations in the PCSK9 gene that affect PCSK9 protein expression, primary sequence and/or function by administering said antibodies or fragments thereof alone or in combination with other active agents.

The subject anti-PCSK9 antibodies and antibody fragments according to the invention can also in particular be used for treating any subject having a condition or at risk of developing a condition wherein modulation of lipid or cholesterol levels is clinically desirable or where the subject has a condition that is often associated with high lipids or cholesterol.

The subject anti-PCSK9 antibodies and antibody fragments according to the invention can also in particular be used for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma, hypertension, angina and related conditions by administration of the subject anti-PCSK9 antibodies and antibody fragments alone or in association with other active agents.

The subject anti-PCSK9 antibodies and antibody fragments according to the invention can also in particular be used for improving blood cholesterol markers associated with increased risk of heart disease using the subject antibodies and antibody fragments alone or in association with other active agents. These markers include, but are not limited to, high total cholesterol, high LDL, high total cholesterol to HDL ratio and high LDL-C to HDL ratio.

The subject anti-PCSK9 antibodies and antibody fragments according to the invention can also in particular be used in any of the aforementioned therapeutic indications or conditions in combination with other drugs that are typically used to treat such disorders, wherein the antibody and other drug or agent may be co-administered or separately administered. Examples of drugs include that may be co-administered with the subject anti-PCSK9 antibodies or antibody fragments or in the same therapeutic regimen include by way of example statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol or aberrant lipid levels or lipid metabolism.

The invention further relates to compositions containing the subject anti-PCSK9 antibodies or antibody fragments, especially compositions are suitable for in vivo administration, e.g., subcutaneous, intravenous, intradermal, intranasal, intrathecal, vaginal, rectal, and other injectable or topical administrable dosage forms.

More specifically, the invention provides compositions containing the subject anti-PCSK9 antibodies or antibody fragments, especially compositions which are suitable for in vivo administration, e.g., subcutaneous, intravenous, intradermal, intranasal, intrathecal, vaginal, rectal, oral and other injectable or topical dosage forms which optionally may contain another active agent such as statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol. The invention also provides novel dosage regimens using the subject anti-PCSK9 antibodies or antibody fragments, alone or in association with another active, especially subcutaneous, oral and intravenous dosing regimens.

Other uses for the antibodies or antibody fragments according to the invention include, for example, diagnosis of PCSK9-associated diseases or conditions and screening assays to determine the presence or absence of PCSK9. Some of the antibody or antibody fragment according to the invention described herein are useful in treating consequences, symptoms, and/or the pathology associated with PCSK9 activity.

Exemplary anti-PCSK9 antibodies and antibody fragments according to the invention, and the specific CDRs thereof are identified in the following section. For the reader's convenience, each exemplified antibody or fragment, and sequences contained therein, are separately described under a Header that identifies the exemplified antibody by a specific nomenclature, e.g., Ab1, Ab2 and the like.

Antibody Ab1

In one embodiment, the invention includes antibodies and antibody fragments having binding specificity to PCSK9 that possess a heavy chain sequence comprising the sequence set forth below:

```
                                           (SEQ ID NO: 1)
QSVEESGGRLVTPGTPLTLTCTVSGFSLSSYWMTWVRQAPGKGLEYIGII

SSSGSTYYATWAKGRFTISKTSSTTVDLEITSPTTEDTATYFCARDSAFS

SGLEFNIWGPGTLVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKD

TLMISRTPEVTCVVVDVSHEDPEVKFNWYVDGVEVHNAKTKPREEQYAST

YRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK.
```

In one embodiment, the invention includes antibodies and antibody fragments having binding specificity to PCSK9 that contain a variable heavy chain sequence comprising the sequence set forth below:

```
                                           (SEQ ID NO: 2)
QSVEESGGRLVTPGTPLTLTCTVSGFSLSSYWMTWVRQAPGKGLEYIGII

SSSGSTYYATWAKGRFTISKTSSTTVDLEITSPTTEDTATYFCARDSAFS

SGLEFNIWGPGTLVTVSS.
```

In another embodiment, the invention includes antibodies and antibody fragments having binding specificity to PCSK9 that possess the same epitopic specificity as Ab1 and which contain a constant heavy chain sequence comprising the sequence set forth below:

```
                                          (SEQ ID NO: 10)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                          (SEQ ID NO: 21)
AYDLTQTPASVEVAVGGTVTIKCQASQSVYSNWLSWYQQKPGQPPKLLIY

DASDLASGVPSRFKGSGSGTQFTLTISGVQCDDAATYYCQQGQSSSDIDN

TFGGGTEVVVKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC.
```

In another embodiment, the invention includes antibodies and antibody fragments having binding specificity to PCSK9 that contain a variable light chain sequence comprising the sequence set forth below:

(SEQ ID NO: 22)
AYDLTQTPASVEVAVGGTVTIKCQASQSVYSNWLSWYQQKPGQPPKLLIY

DASDLASGVPSRFKGSGSGTQFTLTISGVQCDDAATYYCQQGQSSSDID

NTFGGGTEVVVK.

In another embodiment, the invention includes antibodies and antibody fragments having binding specificity to PCSK9 that bind the same epitope as Ab1 which contain a constant light chain sequence comprising the sequence set forth below:

(SEQ ID NO: 30)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or which contain the variable heavy chain sequence of SEQ ID NO: 2, and/or which further contain one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or which contain the variable light chain sequence of SEQ ID NO: 22, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2, and/or one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 1 or SEQ ID NO: 2 or polypeptides that are at least 90% or 95% identical thereto. In another embodiment of the invention, antibody fragments of the invention comprise, or alternatively consist of, the polypeptide sequence of SEQ ID NO: 21 or SEQ ID NO: 22 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or the variable heavy chain sequence of SEQ ID NO: 2 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or the variable light chain sequence of SEQ ID NO: 22 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 2; the variable light chain region of SEQ ID NO: 22; the complementarity-determining regions (SEQ ID NO: 4; SEQ ID NO: 6; and SEQ ID NO: 8) of the variable heavy chain region of SEQ ID NO: 2; and the complementarity-determining regions (SEQ ID NO: 24; SEQ ID NO: 26; and SEQ ID NO: 28) of the variable light chain region of SEQ ID NO: 22 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 2; the variable light chain region of SEQ ID NO: 22; the framework regions (SEQ ID NO: 3; SEQ ID NO: 5; SEQ ID NO: 7; and SEQ ID NO: 9) of the variable heavy chain region of SEQ ID NO: 2; and the framework regions (SEQ ID NO: 23; SEQ ID NO: 25; SEQ ID NO: 27; and SEQ ID NO: 29) of the variable light chain region of SEQ ID NO: 22 or sequences that are at least 90% or 95% identical thereto.

In a particularly preferred embodiment of the invention, the anti-PCSK9 antibody is Ab1, comprising, or alternatively consisting of, SEQ ID NO: 1 and SEQ ID NO: 21, or an antibody or antibody fragment comprising the CDRs of Ab1 and having at least one of the biological activities set forth herein or is an anti-PCSK9 antibody that competes with Ab1 in binding PCSK9, preferably one containing sequences that are at least 90%, 95%, 96%, 97%, 98% or 99% identical to that of Ab1 or an antibody that binds to the same or overlapping epitope(s) on PCSK9 as Ab1.

In a further particularly preferred embodiment of the invention, antibody fragments comprise, or alternatively consist of, Fab (fragment antigen binding) fragments having binding specificity for PCSK9. With respect to antibody Ab1, the Fab fragment preferably includes the variable heavy chain sequence of SEQ ID NO: 2 and the variable light chain sequence of SEQ ID NO: 22 or sequences that are at least 90%, 95%, 96%, 97%, 98% or 99% identical thereto. This embodiment of the invention further includes Fabs containing additions, deletions, and variants of SEQ ID NO: 2 and/or SEQ ID NO: 22 which retain the binding specificity for PCSK9.

In one embodiment of the invention described herein (infra), Fab fragments may be produced by enzymatic digestion (e.g., papain) of Ab1. In another embodiment of the invention, anti-PCSK9 antibodies such as Ab1 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab1 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab2

In one embodiment, the invention includes antibodies and antibody fragments having binding specificity to PCSK9 that possess a heavy chain sequence comprising the sequence set forth below:

```
                                          (SEQ ID NO: 41)
QSVEESGGRLVTPGTPLTLTCTVSGFSLSSYAMSWVRQAPGKGLEWIGII

DAIDNTYYASWAKGRFTISKTSTTVDLKMTSLTTGDTATYFCARASILGY

SIATGFNIWGPGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.
```

In one embodiment, the invention includes antibodies and antibody fragments having binding specificity to PCSK9 that contain a variable heavy chain sequence comprising the sequence set forth below:

```
                                          (SEQ ID NO: 42)
QSVEESGGRLVTPGTPLTLTCTVSGFSLSSYAMSWVRQAPGKGLEWIGII

DAIDNTYYASWAKGRFTISKTSTTVDLKMTSLTTGDTATYFCARASILGY

SIATGFNIWGPGTLVTVSS.
```

In another embodiment, the invention includes antibodies and antibody fragments having binding specificity to PCSK9 that possess the same epitopic specificity as Ab2 and which contain a constant heavy chain sequence comprising the sequence set forth below:

```
                                          (SEQ ID NO: 50)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                          (SEQ ID NO: 61)
AYDMTQTPASVEVAVGGTVTIKCQASQSISSHLAWYQQKSGQPPKLLIYR

ASTLESGVSSRFKGSGSGTEFTLTISDLECADAATYYCQQGYGVSDVDNG

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to PCSK9 that contain a variable light chain sequence comprising the sequence set forth below:

```
                                          (SEQ ID NO: 62)
AYDMTQTPASVEVAVGGTVTIKCQASQSISSHLAWYQQKSGQPPKLLIYR

ASTLESGVSSRFKGSGSGTEFTLTISDLECADAATYYCQQGYGVSDVDNG

FGGGTEVVVK.
```

In another embodiment, the invention includes antibodies and antibody fragments having binding specificity to PCSK9 that bind the same epitope as Ab2 which contain a constant light chain sequence comprising the sequence set forth below:

(SEQ ID NO: 70)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or which contain the variable heavy chain sequence of SEQ ID NO: 42, and/or which further contain one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or which contain the variable light chain sequence of SEQ ID NO: 62, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42, and/or one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 41 or SEQ ID NO: 42 or polypeptides that are at least 90% or 95% identical thereto. In another embodiment of the invention, antibody fragments of the invention comprise, or alternatively consist of, the polypeptide sequence of SEQ ID NO: 61 or SEQ ID NO: 62 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or the variable heavy chain sequence of SEQ ID NO: 42 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or the variable light chain sequence of SEQ ID NO: 62 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 42; the variable light chain region of SEQ ID NO: 62; the complementarity-determining regions (SEQ ID NO: 44; SEQ ID NO: 46; and SEQ ID NO: 48) of the variable heavy chain region of SEQ ID NO: 42; and the complementarity-determining regions (SEQ ID NO: 64; SEQ ID NO: 66; and SEQ ID NO: 68) of the variable light chain region of SEQ ID NO: 62 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 42; the variable light chain region of SEQ ID NO: 62; the framework regions (SEQ ID NO: 43; SEQ ID NO: 45; SEQ ID NO: 47; and SEQ ID NO: 49) of the variable heavy chain region of SEQ ID NO: 42; and the framework regions (SEQ ID NO: 63; SEQ ID NO: 65; SEQ ID NO: 67; and SEQ ID NO: 69) of the variable light chain region of SEQ ID NO: 62 or sequences that are at least 90% or 95% identical thereto.

In a particularly preferred embodiment of the invention, the anti-PCSK9 antibody is Ab2, comprising, or alternatively consisting of, SEQ ID NO: 41 and SEQ ID NO: 61, or an antibody or antibody fragment comprising the CDRs of Ab2 and having at least one of the biological activities set forth herein or is an anti-PCSK9 antibody that competes with Ab2 in binding PCSK9, preferably one containing sequences that are at least 90%, 95%, 96%, 97%, 98% or 99% identical to that of Ab2 or an antibody that binds to the same or overlapping epitope(s) on PCSK9 as Ab2.

In a further particularly preferred embodiment of the invention, antibody fragments comprise, or alternatively consist of, Fab (fragment antigen binding) fragments having binding specificity for PCSK9. With respect to antibody Ab2, the Fab fragment preferably includes the variable heavy chain sequence of SEQ ID NO: 42 and the variable light chain sequence of SEQ ID NO: 62 or sequences that are at least 90%, 95%, 96%, 97%, 98% or 99% identical thereto. This embodiment of the invention further includes Fabs containing additions, deletions, and variants of SEQ ID NO: 42 and/or SEQ ID NO: 62 which retain the binding specificity for PCSK9.

In one embodiment of the invention described herein (infra), Fab fragments may be produced by enzymatic digestion (e.g., papain) of Ab2. In another embodiment of the invention, anti-PCSK9 antibodies such as Ab2 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab2 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab3

In one embodiment, the invention includes antibodies and antibody fragments having binding specificity to PCSK9 that possess a heavy chain sequence comprising the sequence set forth below:

(SEQ ID NO: 81)
QSVEESGGRLVTPGGSLTLTCTASGFSLSSYYMSWVRQAPGKGLEWIGII

YPSGSTYYASWAKGRFTISKTSTTVDLKITSPTVEDTATYFCARGGAYAT

LNLWGPGTLVTVSSASTKGPSVFPLAPSSKSTSGGTAALGCLVKDYFPEP

VTVSWNSGALTSGVHTFPAVLQSSGLYSLSSVVTVPSSSLGTQTYICNVN

HKPSNTKVDKRVEPKSCDKTHTCPPCPAPELLGGPSVFLFPPKPKDTLMI

SRTPEVTCVVVDVSHEDPEVKFNWYVDGVEVHNAKTKPREEQYASTYRVV

SVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGS

FFLYSKLTVDKSRWQQGNVFSCSVMHEALHNHYTQKSLSLSPGK.

In one embodiment, the invention includes antibodies and antibody fragments having binding specificity to PCSK9 that contain a variable heavy chain sequence comprising the sequence set forth below:

(SEQ ID NO: 82)
QSVEESGGRLVTPGGSLTLTCTASGFSLSSYYMSWVRQAPGKGLEWIGII

YPSGSTYYASWAKGRFTISKTSTTVDLKITSPTVEDTATYFCARGGAYAT

LNLWGPGTLVTVSS.

In another embodiment, the invention includes antibodies and antibody fragments having binding specificity to PCSK9 that possess the same epitopic specificity as Ab3 and which contain a constant heavy chain sequence comprising the sequence set forth below:

(SEQ ID NO: 90)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 101)
AVLTQTPSPVSAAVGGTVTISCQSSQSVYHNNLLSWYQQKPGQPPKLLIY

DASKLTSGVSSRFSGSGSGTQFTLTISGVQCDDAATYYCLGGYDDDADNG

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 102)
AVLTQTPSPVSAAVGGTVTISCQSSQSVYHNNLLSWYQQKPGQPPKLLIY

DASKLTSGVSSRFSGSGSGTQFTLTISGVQCDDAATYYCLGGYDDDADNG

FGGGTEVVVK.

In another embodiment, the invention includes antibodies and antibody fragments having binding specificity to PCSK9 that bind the same epitope as Ab3 which contain a constant light chain sequence comprising the sequence set forth below:

(SEQ ID NO: 110)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or which contain the variable heavy chain sequence of SEQ ID NO: 82, and/or which further contain one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or which contain the variable light chain sequence of SEQ ID NO: 102, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82, and/or one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 81 or SEQ ID NO: 82 or polypeptides that are at least 90% or 95% identical thereto. In another embodiment of the invention, antibody fragments of the invention comprise, or alternatively consist of, the polypeptide sequence of SEQ ID NO: 101 or SEQ ID NO: 102 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or the variable heavy chain sequence of SEQ ID NO: 82 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or the variable light chain sequence of SEQ ID NO: 102 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 82; the variable light chain region of SEQ ID NO: 102; the complementarity-determining regions (SEQ ID NO: 84; SEQ ID NO: 86; and SEQ ID NO: 88) of the variable heavy chain region of SEQ ID NO: 82; and the complementarity-determining regions (SEQ ID NO: 104; SEQ ID NO: 106; and SEQ ID NO: 108) of the variable light chain region of SEQ ID NO: 102 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 82; the variable light chain region of SEQ ID NO: 102; the framework regions (SEQ ID NO: 83; SEQ ID NO: 85; SEQ ID NO: 87; and SEQ ID NO: 89) of the variable heavy chain region of SEQ ID NO: 82; and the framework regions (SEQ ID NO: 103; SEQ ID NO: 105; SEQ ID NO: 107; and SEQ ID NO: 109) of the variable light chain region of SEQ ID NO: 102 or sequences that are at least 90% or 95% identical thereto.

In a particularly preferred embodiment of the invention, the anti-PCSK9 antibody is Ab3, comprising, or alternatively consisting of, SEQ ID NO: 81 and SEQ ID NO: 101, or an antibody or antibody fragment comprising the CDRs of Ab3 and having at least one of the biological activities set forth herein or is an anti-PCSK9 antibody that competes with Ab3 in binding PCSK9, preferably one containing sequences that are at least 90%, 95%, 96%, 97%, 98% or 99% identical to that of Ab3 or an antibody that binds to the same or overlapping epitope(s) on PCSK9 as Ab3.

In a further particularly preferred embodiment of the invention, antibody fragments comprise, or alternatively consist of, Fab (fragment antigen binding) fragments having binding specificity for PCSK9. With respect to antibody Ab3, the Fab fragment preferably includes the variable heavy chain sequence of SEQ ID NO: 82 and the variable light chain sequence of SEQ ID NO: 102 or sequences that are at least 90%, 95%, 96%, 97%, 98% or 99% identical thereto. This embodiment of the invention further includes Fabs containing additions, deletions, and variants of SEQ ID NO: 82 and/or SEQ ID NO: 102 which retain the binding specificity for PCSK9.

In one embodiment of the invention described herein (infra), Fab fragments may be produced by enzymatic digestion (e.g., papain) of Ab3. In another embodiment of the invention, anti-PCSK9 antibodies such as Ab3 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab3 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab4

In one embodiment, the invention includes antibodies and antibody fragments having binding specificity to PCSK9 that possess a heavy chain sequence comprising the sequence set forth below:

(SEQ ID NO: 121)
QSVEESGGRLVTPGTPLTLTCTVSGIDLSSYAMIWVRQAPEKGLEYIGYI

GGIDSTYYASWAKGRFTISKTSTTVDLKMTSPTTEDTATYFCGRWSGTSG

YNTIWGPGTLVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKRVEPKSCDKTHTCPPCPAPELLGGPSVFLFPPKPKDTLM

ISRTPEVTCVVVDVSHEDPEVKFNWYVDGVEVHNAKTKPREEQYASTYRV

VSVLTVLHQDWLNGKEYKCKVSNKALPAPIEKTISKAKGQPREPQVYTLP

PSREEMTKNQVSLTCLVKGFYPSDIAVEWESNGQPENNYKTTPPVLDSDG

SFFLYSKLTVDKSRWQQGNVFSCSVMHEALHNHYTQKSLSLSPGK.

In one embodiment, the invention includes antibodies and antibody fragments having binding specificity to PCSK9 that contain a variable heavy chain sequence comprising the sequence set forth below:

(SEQ ID NO: 122)
QSVEESGGRLVTPGTPLTLTCTVSGIDLSSYAMIWVRQAPEKGLEYIGYI

GGIDSTYYASWAKGRFTISKTSTTVDLKMTSPTTEDTATYFCGRWSGTSG

YNTIWGPGTLVTVSS.

In another embodiment, the invention includes antibodies and antibody fragments having binding specificity to PCSK9 that possess the same epitopic specificity as Ab4 and which contain a constant heavy chain sequence comprising the sequence set forth below:

(SEQ ID NO: 130)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 141)
DVVMTQTPASVEAAVGGTVTIKCQASQSIYSNLAWYQQKPGQPPKLLIYG

ASNLASGVSSRFKGSRSGTEYTLTISDLECADAATYYCQCTGGGDSGNTF

GGGTEVVVKRTVAAPSVFIFPPSDEQLKSGTASVVCLLNNFYPREAKVQW

KVDNALQSGNSQESVTEQDSKDSTYSLSSTLTLSKADYEKHKVYACEVTH

QGLSSPVTKSFNRGEC.

In another embodiment, the invention includes antibodies and antibody fragments having binding specificity to PCSK9 that contain a variable light chain sequence comprising the sequence set forth below:

(SEQ ID NO: 142)
DVVMTQTPASVEAAVGGTVTIKCQASQSIYSNLAWYQQKPGQPPKLLIYG

ASNLASGVSSRFKGSRSGTEYTLTISDLECADAATYYCQCTGGGDSGNTF

GGGTEVVVK.

In another embodiment, the invention includes antibodies and antibody fragments having binding specificity to PCSK9 that bind the same epitope as Ab4 which contain a constant light chain sequence comprising the sequence set forth below:

(SEQ ID NO: 150)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or which contain the variable heavy chain sequence of SEQ ID NO: 122, and/or which further contain one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or which contain the variable light chain sequence of SEQ ID NO: 142, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122, and/or one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 121 or SEQ ID NO: 122 or polypeptides that are at least 90% or 95% identical thereto.

In another embodiment of the invention, antibody fragments of the invention comprise, or alternatively consist of, the polypeptide sequence of SEQ ID NO: 141 or SEQ ID NO: 142 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or the variable heavy chain sequence of SEQ ID NO: 122 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or the variable light chain sequence of SEQ ID NO: 142 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 122; the variable light chain region of SEQ ID NO: 142; the complementarity-determining regions (SEQ ID NO: 124; SEQ ID NO: 126; and SEQ ID NO: 128) of the variable heavy chain region of SEQ ID NO: 122; and the complementarity-determining regions (SEQ ID NO: 144; SEQ ID NO: 146; and SEQ ID NO: 148) of the variable light chain region of SEQ ID NO: 142 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 122; the variable light chain region of SEQ ID NO: 142; the framework regions (SEQ ID NO: 123; SEQ ID NO: 125; SEQ ID NO: 127; and SEQ ID NO: 129) of the variable heavy chain region of SEQ ID NO: 122; and the framework regions (SEQ ID NO: 143; SEQ ID NO: 145; SEQ ID NO: 147; and SEQ ID NO: 149) of the variable light chain region of SEQ ID NO: 142 or sequences that are at least 90% or 95% identical thereto.

In a particularly preferred embodiment of the invention, the anti-PCSK9 antibody is Ab4, comprising, or alternatively consisting of, SEQ ID NO: 121 and SEQ ID NO: 141, or an antibody or antibody fragment comprising the CDRs of Ab4 and having at least one of the biological activities set forth herein or is an anti-PCSK9 antibody that competes with Ab4 in binding PCSK9, preferably one containing sequences that are at least 90%, 95%, 96%, 97%, 98% or 99% identical to that of Ab4 or an antibody that binds to the same or overlapping epitope(s) on PCSK9 as Ab4.

In a further particularly preferred embodiment of the invention, antibody fragments comprise, or alternatively consist of, Fab (fragment antigen binding) fragments having binding specificity for PCSK9. With respect to antibody Ab4, the Fab fragment preferably includes the variable heavy chain sequence of SEQ ID NO: 122 and the variable light chain sequence of SEQ ID NO: 142 or sequences that are at least 90%, 95%, 96%, 97%, 98% or 99% identical thereto. This embodiment of the invention further includes Fabs containing additions, deletions, and variants of SEQ ID NO: 122 and/or SEQ ID NO: 142 which retain the binding specificity for PCSK9.

In one embodiment of the invention described herein (infra), Fab fragments may be produced by enzymatic digestion (e.g., papain) of Ab4. In another embodiment of the invention, anti-PCSK9 antibodies such as Ab4 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab4 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab5

In one embodiment, the invention includes antibodies and antibody fragments having binding specificity to PCSK9 that possess a heavy chain sequence comprising the sequence set forth below:

```
                                      (SEQ ID NO: 161)
QSVEESGGRLVTPGTPLTLTCTVSGFSLSSYAMSWVRQAPGKGLEWIGII

SNSGTTYYASWAKGRFTISKTSTTVDLKITSPTTEDTATYFCARGIYWYW

RVFNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.
```

In one embodiment, the invention includes antibodies and antibody fragments having binding specificity to PCSK9 that contain a variable heavy chain sequence comprising the sequence set forth below:

```
                                      (SEQ ID NO: 162)
QSVEESGGRLVTPGTPLTLTCTVSGFSLSSYAMSWVRQAPGKGLEWIGII

SNSGTTYYASWAKGRFTISKTSTTVDLKITSPTTEDTATYFCARGIYWYW

RVFNLWGPGTLVTVSS.
```

In another embodiment, the invention includes antibodies and antibody fragments having binding specificity to PCSK9 that possess the same epitopic specificity as Ab5 and which contain a constant heavy chain sequence comprising the sequence set forth below:

```
                                      (SEQ ID NO: 170)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                      (SEQ ID NO: 181)
AVLTQTPSPVSAAVGGTVTINCQASQSVYNNLLSWYQQKPGQPPKWYDAS

NLASGVPDRFSGSGSGTQFTLTISGVQCDDAATYYCLGGYDDDADNAFGG

GTEVVVKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.
```

In another embodiment, the invention includes antibodies and antibody fragments having binding specificity to PCSK9 that contain a variable light chain sequence comprising the sequence set forth below:

```
                                      (SEQ ID NO: 182)
AVLTQTPSPVSAAVGGTVTINCQASQSVYNNLLSWYQQKPGQPPKLLIYD

ASNLASGVPDRFSGSGSGTQFTLTISGVQCDDAATYYCLGGYDDDADNAF

GGGTEVVVK.
```

In another embodiment, the invention includes antibodies and antibody fragments having binding specificity to PCSK9 that bind the same epitope as Ab5 which contain a constant light chain sequence comprising the sequence set forth below:

```
                                      (SEQ ID NO: 190)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.
```

In another embodiment, the invention includes antibodies and antibody fragments having binding specificity to PCSK9 that contain one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or which contain the variable heavy chain sequence of SEQ ID NO: 162, and/or which further contain one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or which contain the variable light chain sequence of SEQ ID NO: 182, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162, and/or one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 161 or SEQ ID NO: 162 or polypeptides that are at least 90% or 95% identical thereto. In another embodiment of the invention, antibody fragments of the invention comprise, or alternatively consist of, the polypeptide sequence of SEQ ID NO: 181 or SEQ ID NO: 182 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or the variable heavy chain sequence of SEQ ID NO: 162 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or the variable light chain sequence of SEQ ID NO: 182 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 162; the variable light chain region of SEQ ID NO: 182; the complementarity-determining regions (SEQ ID NO: 164; SEQ ID NO: 166; and SEQ ID NO: 168) of the variable heavy chain region of SEQ ID NO: 162; and the complementarity-determining regions (SEQ ID NO: 184; SEQ ID NO: 186; and SEQ ID NO: 188) of the variable light chain region of SEQ ID NO: 182 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 162; the variable light chain region of SEQ ID NO: 182; the framework regions (SEQ ID NO: 163; SEQ ID NO: 165; SEQ ID NO: 167; and SEQ ID NO: 169) of the variable heavy chain region of SEQ ID NO: 162; and the framework regions (SEQ ID NO: 183; SEQ ID NO: 185; SEQ ID NO: 187; and SEQ ID NO: 189) of the variable light chain region of SEQ ID NO: 182 or sequences that are at least 90% or 95% identical thereto.

In a particularly preferred embodiment of the invention, the anti-PCSK9 antibody is Ab5, comprising, or alternatively consisting of, SEQ ID NO: 161 and SEQ ID NO: 181, or an antibody or antibody fragment comprising the CDRs of Ab5 and having at least one of the biological activities set forth herein or is an anti-PCSK9 antibody that competes with Ab5 in binding PCSK9, preferably one containing sequences that are at least 90%, 95%, 96%, 97%, 98% or 99% identical to that of Ab5 or an antibody that binds to the same or overlapping epitope(s) on PCSK9 as Ab5.

In a further particularly preferred embodiment of the invention, antibody fragments comprise, or alternatively consist of, Fab (fragment antigen binding) fragments having binding specificity for PCSK9. With respect to antibody Ab5, the Fab fragment preferably includes the variable heavy chain sequence of SEQ ID NO: 162 and the variable light chain sequence of SEQ ID NO: 182 or sequences that are at least 90%, 95%, 96%, 97%, 98% or 99% identical thereto. This embodiment of the invention further includes Fabs containing additions, deletions, and variants of SEQ ID NO: 162 and/or SEQ ID NO: 182 which retain the binding specificity for PCSK9.

In one embodiment of the invention described herein (infra), Fab fragments may be produced by enzymatic digestion (e.g., papain) of Ab5. In another embodiment of the invention, anti-PCSK9 antibodies such as Ab5 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab5 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab6

In one embodiment, the invention includes antibodies and antibody fragments having binding specificity to PCSK9 that possess a heavy chain sequence comprising the sequence set forth below:

```
                                              (SEQ ID NO: 201)
QEQLEESGGDLVKPEGSLTLTCTASGFSFSSNYWICWVRQAPGKGLEWIG

CIRDGGGTYYASWAKGRLTISMTSSTTVTLQLNSLTAADTATYFCASDIN

DGWLGQFNLWGPGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA
```

-continued

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 202)
QEQLEESGGDLVKPEGSLTLTCTASGFSFSSNYWICWVRQAPGKGLEWIG

CIRDGGGTYYASWAKGRLTISMTSSTTVTLQLNSLTAADTATYFCASDIN

DGWLGQFNLWGPGTLVTVSS.

In another embodiment, the invention includes antibodies and antibody fragments having binding specificity to PCSK9 that possess the same epitopic specificity as Ab6 and which contain a constant heavy chain sequence comprising the sequence set forth below:

(SEQ ID NO: 210)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 221)
ADIVMTQTPASVEVAVGGTVTIKCQASQSISAYLAWYQQKPGQPPKLLIY

RAYTLASGVPSRFKGSGSGTQFTLTISDLECADAATYYCQSYYSVTTNTY

GNTFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 222)
ADIVMTQTPASVEVAVGGTVTIKCQASQSISAYLAWYQQKPGQPPKLLIY

RAYTLASGVPSRFKGSGSGTQFTLTISDLECADAATYYCQSYYSVTTNTY

GNTFGGGTEVVVK.

In another embodiment, the invention includes antibodies and antibody fragments having binding specificity to PCSK9 that bind the same epitope as Ab6 which contain a constant light chain sequence comprising the sequence set forth below:

(SEQ ID NO: 230)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 204; SEQ ID NO: 206; and SEQ ID NO: 208 which correspond to the complementarity-determining regions (CDRs, or hypervariable regions) of the heavy chain sequence of SEQ ID NO: 201 or which contain the variable heavy chain sequence of SEQ ID NO: 202, and/or which further contain one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or which contain the variable light chain sequence of SEQ ID NO: 222, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202, and/or one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 201 or SEQ ID NO: 202 or polypeptides that are at least 90% or 95% identical thereto. In another embodiment of the invention, antibody fragments of the invention comprise, or alternatively consist of, the polypeptide sequence of SEQ ID NO: 221 or SEQ ID NO: 222 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 204; SEQ ID NO: 206; and SEQ ID NO: 208 which correspond to the complementarity-determining regions (CDRs, or hypervariable regions)

of the heavy chain sequence of SEQ ID NO: 201 or the variable heavy chain sequence of SEQ ID NO: 202 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or the variable light chain sequence of SEQ ID NO: 222 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 202; the variable light chain region of SEQ ID NO: 222; the complementarity-determining regions (SEQ ID NO: 204; SEQ ID NO: 206; and SEQ ID NO: 208) of the variable heavy chain region of SEQ ID NO: 202; and the complementarity-determining regions (SEQ ID NO: 224; SEQ ID NO: 226; and SEQ ID NO: 228) of the variable light chain region of SEQ ID NO: 222 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 202; the variable light chain region of SEQ ID NO: 222; the framework regions (SEQ ID NO: 203; SEQ ID NO: 205; SEQ ID NO: 207; and SEQ ID NO: 209) of the variable heavy chain region of SEQ ID NO: 202; and the framework regions (SEQ ID NO: 223; SEQ ID NO: 225; SEQ ID NO: 227; and SEQ ID NO: 229) of the variable light chain region of SEQ ID NO: 222 or sequences that are at least 90% or 95% identical thereto.

In a particularly preferred embodiment of the invention, the anti-PCSK9 antibody is Ab6, comprising, or alternatively consisting of, SEQ ID NO: 201 and SEQ ID NO: 221, or an antibody or antibody fragment comprising the CDRs of Ab6 and having at least one of the biological activities set forth herein or is an anti-PCSK9 antibody that competes with Ab6 in binding PCSK9, preferably one containing sequences that are at least 90%, 95%, 96%, 97%, 98% or 99% identical to that of Ab6 or an antibody that binds to the same or overlapping epitope(s) on PCSK9 as Ab6.

In a further particularly preferred embodiment of the invention, antibody fragments comprise, or alternatively consist of, Fab (fragment antigen binding) fragments having binding specificity for PCSK9. With respect to antibody Ab6, the Fab fragment preferably includes the variable heavy chain sequence of SEQ ID NO: 202 and the variable light chain sequence of SEQ ID NO: 222 or sequences that are at least 90%, 95%, 96%, 97%, 98% or 99% identical thereto. This embodiment of the invention further includes Fabs containing additions, deletions, and variants of SEQ ID NO: 202 and/or SEQ ID NO: 222 which retain the binding specificity for PCSK9.

In one embodiment of the invention described herein (infra), Fab fragments may be produced by enzymatic digestion (e.g., papain) of Ab6. In another embodiment of the invention, anti-PCSK9 antibodies such as Ab6 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab6 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab7

In one embodiment, the invention includes antibodies and antibody fragments having binding specificity to PCSK9 that possess a heavy chain sequence comprising the sequence set forth below:

```
                                         (SEQ ID NO: 241)
EVQLVESGGGLVQPGGSLRLSCAASGFTVSSNYWICWVRQAPGKGLEWIG

CIRDGGGTYYASSAKGRFTISRDNSKNTLYLQMNSLRAEDTAVYYCASDI

NDGWLGQFNLWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKRVEPKSCDKTHTCPPCPAPELLGGPSVFLFPPK

PKDTLMISRTPEVTCVVVDVSHEDPEVKFNWYVDGVEVHNAKTKPREEQY

ASTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

K.
```

In one embodiment, the invention includes antibodies and antibody fragments having binding specificity to PCSK9 that contain a variable heavy chain sequence comprising the sequence set forth below:

```
                                         (SEQ ID NO: 242)
EVQLVESGGGLVQPGGSLRLSCAASGFTVSSNYWICWVRQAPGKGLEWIG

CIRDGGGTYYASSAKGRFTISRDNSKNTLYLQMNSLRAEDTAVYYCASDI

NDGWLGQFNLWGQGTLVTVSS.
```

In another embodiment, the invention includes antibodies and antibody fragments having binding specificity to PCSK9 that possess the same epitopic specificity as Ab7 and which contain a constant heavy chain sequence comprising the sequence set forth below:

(SEQ ID NO: 250)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 261)
ADIVMTQSPSSLSASVGDRVTIKCQASQSISAYLAWYQQKPGKVPKLLIY

RAYTLASGVPSRFSGSGSGTDFTLTISSLQPEDVATYYCQSYYSVTTNTY

GNTFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 262)
ADIVMTQSPSSLSASVGDRVTIKCQASQSISAYLAWYQQKPGKVPKLLIY

RAYTLASGVPSRFSGSGSGTDFTLTISSLQPEDVATYYCQSYYSVTTNTY

GNTFGGGTKVEIK.

In another embodiment, the invention includes antibodies and antibody fragments having binding specificity to PCSK9 that bind the same epitope as Ab7 which contain a constant light chain sequence comprising the sequence set forth below:

(SEQ ID NO: 270)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or which contain the variable heavy chain sequence of SEQ ID NO: 242, and/or which further contain one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or which contain the variable light chain sequence of SEQ ID NO: 262, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242, and/or one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 241 or SEQ ID NO: 242 or polypeptides that are at least 90% or 95% identical thereto. In another embodiment of the invention, antibody fragments of the invention comprise, or alternatively consist of, the polypeptide sequence of SEQ ID NO: 261 or SEQ ID NO: 262 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or the variable heavy chain sequence of SEQ ID NO: 242 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or the variable light chain sequence of SEQ ID NO: 262 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 242; the variable light chain region of SEQ ID NO: 262; the complementarity-determining regions (SEQ ID NO: 244; SEQ ID NO: 246; and SEQ ID NO: 248) of the variable heavy chain region of SEQ ID NO: 242; and the complementarity-determining regions (SEQ ID NO: 264; SEQ ID NO: 266; and SEQ ID NO: 268) of the variable light chain region of SEQ ID NO: 262 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 242; the variable light chain region of SEQ ID NO: 262; the framework regions (SEQ ID NO: 243; SEQ ID NO: 245; SEQ ID NO: 247; and SEQ ID NO: 249) of the variable heavy chain region of SEQ ID NO: 242; and the framework regions (SEQ ID NO: 263; SEQ ID NO: 265; SEQ ID NO: 267; and SEQ ID NO: 269) of the variable light chain region of SEQ ID NO: 262 or sequences that are at least 90% or 95% identical thereto.

In a particularly preferred embodiment of the invention, the anti-PCSK9 antibody is Ab7, comprising, or alternatively consisting of, SEQ ID NO: 241 and SEQ ID NO: 261, or an antibody or antibody fragment comprising the CDRs of Ab7 and having at least one of the biological activities set forth herein or is an anti-PCSK9 antibody that competes with Ab7 in binding PCSK9, preferably one containing sequences that are at least 90%, 95%, 96%, 97%, 98% or 99% identical to that of Ab7 or an antibody that binds to the same or overlapping epitope(s) on PCSK9 as Ab7.

In a further particularly preferred embodiment of the invention, antibody fragments comprise, or alternatively consist of, Fab (fragment antigen binding) fragments having binding specificity for PCSK9. With respect to antibody Ab7, the Fab fragment preferably includes the variable heavy chain sequence of SEQ ID NO: 242 and the variable light chain sequence of SEQ ID NO: 262 or sequences that are at least 90%, 95%, 96%, 97%, 98% or 99% identical thereto. This embodiment of the invention further includes Fabs containing additions, deletions, and variants of SEQ ID NO: 242 and/or SEQ ID NO: 262 which retain the binding specificity for PCSK9.

In one embodiment of the invention described herein (infra), Fab fragments may be produced by enzymatic digestion (e.g., papain) of Ab7. In another embodiment of the invention, anti-PCSK9 antibodies such as Ab7 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab7 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab8

In one embodiment, the invention includes antibodies and antibody fragments having binding specificity to PCSK9 that possess a heavy chain sequence comprising the sequence set forth below:

(SEQ ID NO: 281)
QEQLVESGGGLVQPEGSLTLTCTASGFSFTSDYYMCWVRQAPGKGLEWIG

CISTGDGSTYYASWAKGRFTISKPSSTTVTLQMTRLTAADTATYFCARDR

YYSYAYGAYVYASDLWGPGTLVTVSSASTKGPSVFPLAPSSKSTSGGTAA

LGCLVKDYFPEPVTVSWNSGALTSGVHTFPAVLQSSGLYSLSSVVTVPSS

SLGTQTYICNVNHKPSNTKVDKRVEPKSCDKTHTCPPCPAPELLGGPSVF

LFPPKPKDTLMISRTPEVTCVVVDVSHEDPEVKFNWYVDGVEVHNAKTKP

REEQYASTYRVVSVLTVLHQDWLNGKEYKCKVSNKALPAPIEKTISKAKG

QPREPQVYTLPPSREEMTKNQVSLTCLVKGFYPSDIAVEWESNGQPENNY

KTTPPVLDSDGSFFLYSKLTVDKSRWQQGNVFSCSVMHEALHNHYTQKSL

SLSPGK.

In one embodiment, the invention includes antibodies and antibody fragments having binding specificity to PCSK9 that contain a variable heavy chain sequence comprising the sequence set forth below:

(SEQ ID NO: 282)
QEQLVESGGGLVQPEGSLTLTCTASGFSFTSDYYMCWVRQAPGKGLEWIG

CISTGDGSTYYASWAKGRFTISKPSSTTVTLQMTRLTAADTATYFCARDR

YYSYAYGAYVYASDLWGPGTLVTVSS.

In another embodiment, the invention includes antibodies and antibody fragments having binding specificity to PCSK9 that possess the same epitopic specificity as Ab8 and which contain a constant heavy chain sequence comprising the sequence set forth below:

(SEQ ID NO: 290)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 301)
ADIVMTQTPASVSEPVGGTVTINCQASESIRNYLSWYQQKPGQRPKLLIY

GASTLASGVPSRFKGSGSGTDFTLTISDLECADAATYYCQSNYGISSRSY

VNGFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 302)
ADIVMTQTPASVSEPVGGTVTINCQASESIRNYLSWYQQKPGQRPKLLIY

GASTLASGVPSRFKGSGSGTDFTLTISDLECADAATYYCQSNYGISSRSY

VNGFGGGTEVVVK.

In another embodiment, the invention includes antibodies and antibody fragments having binding specificity to PCSK9 that bind the same epitope as Ab8 which contain a constant light chain sequence comprising the sequence set forth below:

(SEQ ID NO: 310)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or which contain the variable heavy chain sequence of SEQ ID NO: 282, and/or which further contain one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or which contain the variable light chain sequence of SEQ ID NO: 302, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282, and/or one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 281 or SEQ ID NO: 282 or polypeptides that are at least 90% or 95% identical thereto. In another embodiment of the invention, antibody fragments of the invention comprise, or alternatively consist of, the polypeptide sequence of SEQ ID NO: 301 or SEQ ID NO: 302 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or the variable heavy chain sequence of SEQ ID NO: 282 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or the variable light chain sequence of SEQ ID NO: 302 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 282; the variable light chain region of SEQ ID NO: 302; the complementarity-determining regions (SEQ ID NO: 284; SEQ ID NO: 286; and SEQ ID NO: 288) of the variable heavy chain region of SEQ ID NO: 282; and the complementarity-determining regions (SEQ ID NO: 304; SEQ ID NO: 306; and SEQ ID NO: 308) of the variable light chain region of SEQ ID NO: 302 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 282; the variable light chain region of SEQ ID NO: 302; the framework regions (SEQ ID NO: 283; SEQ ID NO: 285; SEQ ID NO: 287; and SEQ ID NO: 289) of the variable heavy chain region of SEQ ID NO: 282; and the framework regions (SEQ ID NO: 303; SEQ ID NO: 305; SEQ ID NO: 307; and SEQ ID NO: 309) of the variable light chain region of SEQ ID NO: 302 or sequences that are at least 90% or 95% identical thereto.

In a particularly preferred embodiment of the invention, the anti-PCSK9 antibody is Ab8, comprising, or alternatively consisting of, SEQ ID NO: 281 and SEQ ID NO: 301, or an antibody or antibody fragment comprising the CDRs of Ab8 and having at least one of the biological activities set forth herein or is an anti-PCSK9 antibody that competes with Ab8 in binding PCSK9, preferably one containing sequences that are at least 90%, 95%, 96%, 97%, 98% or 99% identical to that of Ab8 or an antibody that binds to the same or overlapping epitope(s) on PCSK9 as Ab8.

In a further particularly preferred embodiment of the invention, antibody fragments comprise, or alternatively consist of, Fab (fragment antigen binding) fragments having binding specificity for PCSK9. With respect to antibody Ab8, the Fab fragment preferably includes the variable heavy chain sequence of SEQ ID NO: 282 and the variable light chain sequence of SEQ ID NO: 302 or sequences that are at least 90%, 95%, 96%, 97%, 98% or 99% identical thereto. This embodiment of the invention further includes Fabs containing additions, deletions, and variants of SEQ ID NO: 282 and/or SEQ ID NO: 302 which retain the binding specificity for PCSK9.

In one embodiment of the invention described herein (infra), Fab fragments may be produced by enzymatic digestion (e.g., papain) of Ab8. In another embodiment of the invention, anti-PCSK9 antibodies such as Ab8 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab8 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab9

In one embodiment, the invention includes antibodies and antibody fragments having binding specificity to PCSK9 that possess a heavy chain sequence comprising the sequence set forth below:

```
                                            (SEQ ID NO: 321)
QSVEESGGRLVTPGTPLTLTCTVSGIDLSSYAMGWVRQAPGKGLEYIGII

VSYGPTYYASWAKGRFTISKTSTTVDLKITSPTAEDTATYFCARDLDANS

SGYYGCFNIWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLS

PGK.
```

In one embodiment, the invention includes antibodies and antibody fragments having binding specificity to PCSK9 that contain a variable heavy chain sequence comprising the sequence set forth below:

```
                                            (SEQ ID NO: 322)
QSVEESGGRLVTPGTPLTLTCTVSGIDLSSYAMGWVRQAPGKGLEYIGII

VSYGPTYYASWAKGRFTISKTSTTVDLKITSPTAEDTATYFCARDLDANS

SGYYGCFNIWGQGTLVTVSS.
```

In another embodiment, the invention includes antibodies and antibody fragments having binding specificity to PCSK9 that possess the same epitopic specificity as Ab9 and which contain a constant heavy chain sequence comprising the sequence set forth below:

```
                                            (SEQ ID NO: 330)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                            (SEQ ID NO: 341)
AVVLTQTPASVSAAVGGTVTIKCQASQSISTALAWYQQKPGQPPKLLIYA

ASPLASGVSSRFKSSGSGTEFTLTISDLECADAATYYCQSYYGSSNIAFG

GGTELEILRTVAAPSVFIFPPSDEQLKSGTASVVCLLNNFYPREAKVQWK
```

-continued
```
VDNALQSGNSQESVTEQDSKDSTYSLSSTLTLSKADYEKHKVYACEVTHQ

GLSSPVTKSFNRGEC.
```

In another embodiment, the invention includes antibodies and antibody fragments having binding specificity to PCSK9 that contain a variable light chain sequence comprising the sequence set forth below:

```
                                           (SEQ ID NO: 342)
AVVLTQTPASVSAAVGGTVTIKCQASQSISTALAWYQQKPGQPPKLLIYA

ASPLASGVSSRFKSSGSGTEFTLTISDLECADAATYYCQSYYGSSNIAFG

GGTELEIL.
```

In another embodiment, the invention includes antibodies and antibody fragments having binding specificity to PCSK9 that bind the same epitope as Ab9 which contain a constant light chain sequence comprising the sequence set forth below:

```
                                           (SEQ ID NO: 350)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.
```

In another embodiment, the invention includes antibodies and antibody fragments having binding specificity to PCSK9 that contain one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or which contain the variable heavy chain sequence of SEQ ID NO: 322, and/or which further contain one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or which contain the variable light chain sequence of SEQ ID NO: 342, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322, and/or one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 321 or SEQ ID NO: 322 or polypeptides that are at least 90% or 95% identical thereto. In another embodiment of the invention, antibody fragments of the invention comprise, or alternatively consist of, the polypeptide sequence of SEQ ID NO: 341 or SEQ ID NO: 342 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or the variable heavy chain sequence of SEQ ID NO: 322 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or the variable light chain sequence of SEQ ID NO: 342 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 322; the variable light chain region of SEQ ID NO: 342; the complementarity-determining regions (SEQ ID NO: 324; SEQ ID NO: 326; and SEQ ID NO: 328) of the variable heavy chain region of SEQ ID NO: 322; and the complementarity-determining regions (SEQ ID NO: 344; SEQ ID NO: 346; and SEQ ID NO: 348) of the variable light chain region of SEQ ID NO: 342 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 322; the variable light chain region of SEQ ID NO: 342; the framework regions (SEQ ID NO: 323; SEQ ID NO: 325; SEQ ID NO: 327; and SEQ ID NO: 329) of the variable heavy chain region of SEQ ID NO: 322; and the framework regions (SEQ ID NO: 343; SEQ ID NO: 345; SEQ ID NO: 347; and SEQ ID NO: 349) of the variable light chain region of SEQ ID NO: 342 or sequences that are at least 90% or 95% identical thereto.

In a particularly preferred embodiment of the invention, the anti-PCSK9 antibody is Ab9, comprising, or alternatively consisting of, SEQ ID NO: 321 and SEQ ID NO: 341, or an antibody or antibody fragment comprising the CDRs of Ab9 and having at least one of the biological activities set forth herein or is an anti-PCSK9 antibody that competes with Ab9 in binding PCSK9, preferably one containing sequences that are at least 90%, 95%, 96%, 97%, 98% or 99% identical to that of Ab9 or an antibody that binds to the same or overlapping epitope(s) on PCSK9 as Ab9.

In a further particularly preferred embodiment of the invention, antibody fragments comprise, or alternatively consist of, Fab (fragment antigen binding) fragments having binding specificity for PCSK9. With respect to antibody Ab9, the Fab fragment preferably includes the variable heavy chain sequence of SEQ ID NO: 322 and the variable light chain sequence of SEQ ID NO: 342 or sequences that are at least 90%, 95%, 96%, 97%, 98% or 99% identical thereto. This embodiment of the invention further includes Fabs containing additions, deletions, and variants of SEQ ID NO: 322 and/or SEQ ID NO: 342 which retain the binding specificity for PCSK9.

In one embodiment of the invention described herein (infra), Fab fragments may be produced by enzymatic digestion (e.g., papain) of Ab9. In another embodiment of the invention, anti-PCSK9 antibodies such as Ab9 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab9 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab10

In one embodiment, the invention includes antibodies and antibody fragments having binding specificity to PCSK9 that possess a heavy chain sequence comprising the sequence set forth below:

(SEQ ID NO: 361)
QEQLEESGGDLVKPEGSLTLTCTASGFSFSSSYWICWVRQAPGKGLEWIA

CIRAGGGNYYANWAKGRFTISRTSSTTVTLQMTSLTAADTATYFCASDIN

DGWLGQFNLWGPGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLS

PGK.

In one embodiment, the invention includes antibodies and antibody fragments having binding specificity to PCSK9 that contain a variable heavy chain sequence comprising the sequence set forth below:

(SEQ ID NO: 362)
QEQLEESGGDLVKPEGSLTLTCTASGFSFSSSYWICWVRQAPGKGLEWIA

CIRAGGGNYYANWAKGRFTISRTSSTTVTLQMTSLTAADTATYFCASDIN

DGWLGQFNLWGPGTLVTVSS.

In another embodiment, the invention includes antibodies and antibody fragments having binding specificity to PCSK9 that possess the same epitopic specificity as Ab10 and which contain a constant heavy chain sequence comprising the sequence set forth below:

(SEQ ID NO: 370)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 381)
ANIVMTQTPASVEAAVGGTVTIKCQASQSISNYLAWYQQKPGQPPKLLIY

RTSTLASGVPSRFKGSGSGTQFTLTISDLECADAATYYCQSYYSVTTVAY

GNTFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 382)
ANIVMTQTPASVEAAVGGTVTIKCQASQSISNYLAWYQQKPGQPPKLLIY

RTSTLASGVPSRFKGSGSGTQFTLTISDLECADAATYYCQSYYSVTTVAY

GNTFGGGTEVVVK.

In another embodiment, the invention includes antibodies and antibody fragments having binding specificity to PCSK9 that bind the same epitope as Ab10 which contain a constant light chain sequence comprising the sequence set forth below:

(SEQ ID NO: 390)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or which contain the variable heavy chain sequence of SEQ ID NO: 362, and/or which further contain one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or which contain the variable light chain sequence of SEQ ID NO: 382, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362, and/or one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 361 or SEQ ID NO: 362 or polypeptides that are at least 90% or 95% identical thereto. In another embodiment of the invention, antibody fragments of the invention comprise, or alternatively consist of, the polypeptide sequence of SEQ ID NO: 381 or SEQ ID NO: 382 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or the variable heavy chain sequence of SEQ ID NO: 362 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or the variable light chain sequence of SEQ ID NO: 382 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 362; the variable light chain region of SEQ ID NO: 382; the complementarity-determining regions (SEQ ID NO: 364; SEQ ID NO: 366; and SEQ ID NO: 368) of the variable heavy chain region of SEQ ID NO: 362; and the complementarity-determining regions (SEQ ID NO: 384; SEQ ID NO: 386; and SEQ ID NO: 388) of the variable light chain region of SEQ ID NO: 382 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 362; the variable light chain region of SEQ ID NO: 382; the framework regions (SEQ ID NO: 363; SEQ ID NO: 365; SEQ ID NO: 367; and SEQ ID NO: 369) of the variable heavy chain region of SEQ ID NO: 362; and the framework regions (SEQ ID NO: 383; SEQ ID NO: 385; SEQ ID NO: 387; and SEQ ID NO: 389) of the variable light chain region of SEQ ID NO: 382 or sequences that are at least 90% or 95% identical thereto.

In a particularly preferred embodiment of the invention, the anti-PCSK9 antibody is Ab10, comprising, or alternatively consisting of, SEQ ID NO: 361 and SEQ ID NO: 381, or an antibody or antibody fragment comprising the CDRs of Ab10 and having at least one of the biological activities set forth herein or is an anti-PCSK9 antibody that competes with Ab10 in binding PCSK9, preferably one containing sequences that are at least 90%, 95%, 96%, 97%, 98% or 99% identical to that of Ab10 or an antibody that binds to the same or overlapping epitope(s) on PCSK9 as Ab10.

In a further particularly preferred embodiment of the invention, antibody fragments comprise, or alternatively consist of, Fab (fragment antigen binding) fragments having binding specificity for PCSK9. With respect to antibody Ab10, the Fab fragment preferably includes the variable heavy chain sequence of SEQ ID NO: 362 and the variable light chain sequence of SEQ ID NO: 382 or sequences that are at least 90%, 95%, 96%, 97%, 98% or 99% identical thereto. This embodiment of the invention further includes Fabs containing additions, deletions, and variants of SEQ ID NO: 362 and/or SEQ ID NO: 382 which retain the binding specificity for PCSK9.

In one embodiment of the invention described herein (infra), Fab fragments may be produced by enzymatic digestion (e.g., papain) of Ab10. In another embodiment of the invention, anti-PCSK9 antibodies such as Ab10 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab10 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab11

In one embodiment, the invention includes antibodies and antibody fragments having binding specificity to PCSK9 that possess a heavy chain sequence comprising the sequence set forth below:

(SEQ ID NO: 401)
EVQLVESGGGLVQPGGSLRLSCAASGFTVSSSYWICWVRQAPGKGLEWIA

CIRAGGGNYYANSAKGRFTISRDNSKNTLYLQMNSLRAEDTAVYYCASDI

NDGWLGQFNLWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKRVEPKSCDKTHTCPPCPAPELLGGPSVFLFPPK

PKDTLMISRTPEVTCVVVDVSHEDPEVKFNWYVDGVEVHNAKTKPREEQY

ASTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 402)
EVQLVESGGGLVQPGGSLRLSCAASGFTVSSSYWICWVRQAPGKGLEWIA

CIRAGGGNYYANSAKGRFTISRDNSKNTLYLQMNSLRAEDTAVYYCASDI

NDGWLGQFNLWGQGTLVTVSS.

In another embodiment, the invention includes antibodies and antibody fragments having binding specificity to PCSK9 that possess the same epitopic specificity as Ab11 and which contain a constant heavy chain sequence comprising the sequence set forth below:

(SEQ ID NO: 410)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 421)
ANIVMTQSPSSLSASVGDRVTITCQASQSISNYLAWYQQKPGKVPKLLIY

RTSTLASGVPSRFSGSGSGTDFTLTISSLQPEDVATYYCQSYYSVTTVAY

GNTFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 422)
ANIVMTQSPSSLSASVGDRVTITCQASQSISNYLAWYQQKPGKVPKLLIY

RTSTLASGVPSRFSGSGSGTDFTLTISSLQPEDVATYYCQSYYSVTTVAY

GNTFGGGTKVEIK.

In another embodiment, the invention includes antibodies and antibody fragments having binding specificity to PCSK9 that bind the same epitope as Ab11 which contain a constant light chain sequence comprising the sequence set forth below:

(SEQ ID NO: 430)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or which contain the variable heavy chain sequence of SEQ ID NO: 402, and/or which further contain one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or which contain the variable light chain sequence of SEQ ID NO: 422, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402, and/or one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 401 or SEQ ID NO: 402 or polypeptides that are at least 90% or 95% identical thereto. In another embodiment of the invention, antibody fragments of the invention comprise, or alternatively consist of, the polypeptide sequence of SEQ ID NO: 421 or SEQ ID NO: 422 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or the variable heavy chain sequence of SEQ ID NO: 402 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or the variable light chain sequence of SEQ ID NO: 422 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 402; the variable light chain region of SEQ ID NO: 422; the complementarity-determining regions (SEQ ID NO: 404; SEQ ID NO: 406; and SEQ ID NO: 408) of the variable heavy chain region of SEQ ID NO: 402; and the complementarity-determining regions (SEQ ID NO: 424; SEQ ID NO: 426; and SEQ ID NO: 428) of the variable light chain region of SEQ ID NO: 422 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 402; the variable light chain region of SEQ ID NO: 422; the framework regions (SEQ ID NO: 403; SEQ ID NO: 405; SEQ ID NO: 407; and SEQ ID NO: 409) of the variable heavy chain region of SEQ ID NO: 402; and the framework regions (SEQ ID NO: 423; SEQ ID NO: 425; SEQ ID NO: 427; and SEQ ID NO: 429) of the variable light chain region of SEQ ID NO: 422 or sequences that are at least 90% or 95% identical thereto.

In a particularly preferred embodiment of the invention, the anti-PCSK9 antibody is Ab11, comprising, or alternatively consisting of, SEQ ID NO: 401 and SEQ ID NO: 421, or an antibody or antibody fragment comprising the CDRs of Ab11 and having at least one of the biological activities set forth herein or is an anti-PCSK9 antibody that competes with Ab11 in binding PCSK9, preferably one containing sequences that are at least 90%, 95%, 96%, 97%, 98% or 99% identical to that of Ab11 or an antibody that binds to the same or overlapping epitope(s) on PCSK9 as Ab11.

In a further particularly preferred embodiment of the invention, antibody fragments comprise, or alternatively consist of, Fab (fragment antigen binding) fragments having binding specificity for PCSK9. With respect to antibody Ab11, the Fab fragment preferably includes the variable heavy chain sequence of SEQ ID NO: 402 and the variable light chain sequence of SEQ ID NO: 422 or sequences that are at least 90%, 95%, 96%, 97%, 98% or 99% identical thereto. This embodiment of the invention further includes Fabs containing additions, deletions, and variants of SEQ ID NO: 402 and/or SEQ ID NO: 422 which retain the binding specificity for PCSK9.

In one embodiment of the invention described herein (infra), Fab fragments may be produced by enzymatic digestion (e.g., papain) of Ab11. In another embodiment of the invention, anti-PCSK9 antibodies such as Ab11 or Fab fragments thereof may be produced via expression in mammalian cells such as CHO, NS0 or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab11 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab12

In one embodiment, the invention includes antibodies and antibody fragments having binding specificity to PCSK9 that possess a heavy chain sequence comprising the sequence set forth below:

(SEQ ID NO: 441)
EVQLVESGGGLVQPGGSLRLSCAASGFTVSSSYWICWVRQAPGKGLEWIA

CIRAGGGNYYANSAKGRFTISRDNSKNTLYLQMNSLRAEDTAVYYCASDI

NDGWLGQFNLWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDKRVEPKSCDKTHTCPPCPAPELLGGPSVFLFPPK

PKDTLMISRTPEVTCVVVDVSHEDPEVKFNWYVDGVEVHNAKTKPREEQY

ASTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 442)
EVQLVESGGGLVQPGGSLRLSCAASGFTVSSSYWICWVRQAPGKGLEWIA

CIRAGGGNYYANSAKGRFTISRDNSKNTLYLQMNSLRAEDTAVYYCASDI

NDGWLGQFNLWGQGTLVTVSS.

In another embodiment, the invention includes antibodies and antibody fragments having binding specificity to PCSK9 that possess the same epitopic specificity as Ab12 and which contain a constant heavy chain sequence comprising the sequence set forth below:

(SEQ ID NO: 450)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

-continued
KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 461)
ANIVMTQSPSSLSASVGDRVTIKCQASQSISNYLAWYQQKPGKVPKLLIY

RTSTLASGVPSRFSGSGSGTDFTLTISSLQPEDVATYYCQSYYSVTTVAY

GNTFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 462)
ANIVMTQSPSSLSASVGDRVTIKCQASQSISNYLAWYQQKPGKVPKLLIY

RTSTLASGVPSRFSGSGSGTDFTLTISSLQPEDVATYYCQSYYSVTTVAY

GNTFGGGTKVEIK.

In another embodiment, the invention includes antibodies and antibody fragments having binding specificity to PCSK9 that bind the same epitope as Ab12 which contain a constant light chain sequence comprising the sequence set forth below:

(SEQ ID NO: 470)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or which contain the variable heavy chain sequence of SEQ ID NO: 442, and/or which further contain one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or which contain the variable light chain sequence of SEQ ID NO: 462, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442, and/or one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 441 or SEQ ID NO: 442 or polypeptides that are at least 90% or 95% identical thereto. In another embodiment of the invention, antibody fragments of the invention comprise, or alternatively consist of, the polypeptide sequence of SEQ ID NO: 461 or SEQ ID NO: 462 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or the variable heavy chain sequence of SEQ ID NO: 442 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or the variable light chain sequence of SEQ ID NO: 462 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 442; the variable light chain region of SEQ ID NO: 462; the complementarity-determining regions (SEQ ID NO: 444; SEQ ID NO: 446; and SEQ ID NO: 448) of the variable heavy chain region of SEQ ID NO: 442; and the complementarity-determining regions (SEQ ID NO: 464; SEQ ID NO: 466; and SEQ ID NO: 468) of the variable light chain region of SEQ ID NO: 462 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 442; the variable light chain region of SEQ ID NO: 462; the framework regions (SEQ ID NO: 443; SEQ ID NO: 445; SEQ ID NO: 447; and SEQ ID NO: 449) of the variable heavy chain region of SEQ ID NO: 442; and the framework regions (SEQ ID NO: 463; SEQ ID NO: 465; SEQ ID NO: 467; and SEQ ID NO: 469) of the variable light chain region of SEQ ID NO: 462 or sequences that are at least 90% or 95% identical thereto.

In a particularly preferred embodiment of the invention, the anti-PCSK9 antibody is Ab12, comprising, or alternatively consisting of, SEQ ID NO: 441 and SEQ ID NO: 461, or an antibody or antibody fragment comprising the CDRs of Ab12 and having at least one of the biological activities set forth herein or is an anti-PCSK9 antibody that competes with Ab12 in binding PCSK9, preferably one containing sequences that are at least 90%, 95%, 96%, 97%, 98% or 99% identical to that of Ab12 or an antibody that binds to the same or overlapping epitope(s) on PCSK9 as Ab12.

In a further particularly preferred embodiment of the invention, antibody fragments comprise, or alternatively consist of, Fab (fragment antigen binding) fragments having binding specificity for PCSK9. With respect to antibody Ab12, the Fab fragment preferably includes the variable heavy chain sequence of SEQ ID NO: 442 and the variable light chain sequence of SEQ ID NO: 462 or sequences that are at least 90%, 95%, 96%, 97%, 98% or 99% identical thereto. This embodiment of the invention further includes Fabs containing additions, deletions, and variants of SEQ ID NO: 442 and/or SEQ ID NO: 462 which retain the binding specificity for PCSK9.

In one embodiment of the invention described herein (infra), Fab fragments may be produced by enzymatic digestion (e.g., papain) of Ab12. In another embodiment of the invention, anti-PCSK9 antibodies such as Ab12 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab12 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab13

In one embodiment, the invention includes antibodies and antibody fragments having binding specificity to PCSK9 that possess a heavy chain sequence comprising the sequence set forth below:

(SEQ ID NO: 481)
QSVEESGGRLVTPGTPLTLTCTVSGIDLSTYGVGWVRQAPGKGLEYIGII

SSSGSTYYASWAKGRFTISKTSSTTVDLKMTSLTTEDTATYFCARDWSST

TGYYGYFNMWGPGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 482)
QSVEESGGRLVTPGTPLTLTCTVSGIDLSTYGVGWVRQAPGKGLEYIGII

SSSGSTYYASWAKGRFTISKTSSTTVDLKMTSLTTEDTATYFCARDWSST

TGYYGYFNMWGPGTLVTVSS.

In another embodiment, the invention includes antibodies and antibody fragments having binding specificity to PCSK9 that possess the same epitopic specificity as Ab13 and which contain a constant heavy chain sequence comprising the sequence set forth below:

(SEQ ID NO: 490)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 501)
AFELTQTPSPVSAAVGGTVTIKCQASQSISTALAWYQQKPGQPPKLLIY

GASNLESGVPSRFSGSGSGTQFTLTISDLECADAAIYYCQSSYGSSTLA

FGGGTEVVVKRTVAAPSVFIFPPSDEQLKSGTASVVCLLNNFYPREAKV

QWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 502)
AFELTQTPSPVSAAVGGTVTIKCQASQSISTALAWYQQKPGQPPKLLIY

GASNLESGVPSRFSGSGSGTQFTLTISDLECADAAIYYCQSSYGSSTLA

FGGGTEVVVK.

In another embodiment, the invention includes antibodies and antibody fragments having binding specificity to PCSK9 that bind the same epitope as Ab13 which contain a constant light chain sequence comprising the sequence set forth below:

(SEQ ID NO: 510)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

In another embodiment, the invention includes antibodies and antibody fragments having binding specificity to PCSK9 that contain one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or which contain the variable heavy chain sequence of SEQ ID NO: 482, and/or which further contain one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or which contain the variable light chain sequence of SEQ ID NO: 502, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482, and/or one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 481 or SEQ ID NO: 482 or polypeptides that are at least 90% or 95% identical thereto. In another embodiment of the invention, antibody fragments of the invention comprise, or alternatively consist of, the polypeptide sequence of SEQ ID NO: 501 or SEQ ID NO: 502 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or the variable heavy chain sequence of SEQ ID NO: 482 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or the variable light chain sequence of SEQ ID NO: 502 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 482; the variable light chain region of SEQ ID NO: 502; the complementarity-determining regions (SEQ ID NO: 484; SEQ ID NO: 486; and SEQ ID NO: 488) of the variable heavy chain region of SEQ ID NO: 482; and the complementarity-determining regions (SEQ ID NO: 504; SEQ ID NO: 506; and SEQ ID NO: 508) of the variable light chain region of SEQ ID NO: 502 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 482; the variable light chain region of SEQ ID NO: 502; the framework regions (SEQ ID NO: 483; SEQ ID NO: 485; SEQ ID NO: 487; and SEQ ID NO: 489) of the variable heavy chain region of SEQ ID NO: 482; and the framework regions (SEQ ID NO: 503; SEQ ID NO: 505; SEQ ID NO: 507; and SEQ ID NO: 509) of the variable light chain region of SEQ ID NO: 502 or sequences that are at least 90% or 95% identical thereto.

In a particularly preferred embodiment of the invention, the anti-PCSK9 antibody is Ab13, comprising, or alternatively consisting of, SEQ ID NO: 481 and SEQ ID NO: 501, or an antibody or antibody fragment comprising the CDRs of Ab13 and having at least one of the biological activities set forth herein or is an anti-PCSK9 antibody that competes with Ab13 in binding PCSK9, preferably one containing sequences that are at least 90%, 95%, 96%, 97%, 98% or 99% identical to that of Ab13 or an antibody that binds to the same or overlapping epitope(s) on PCSK9 as Ab13.

In a further particularly preferred embodiment of the invention, antibody fragments comprise, or alternatively consist of, Fab (fragment antigen binding) fragments having binding specificity for PCSK9. With respect to antibody Ab13, the Fab fragment preferably includes the variable heavy chain sequence of SEQ ID NO: 482 and the variable light chain sequence of SEQ ID NO: 502 or sequences that are at least 90%, 95%, 96%, 97%, 98% or 99% identical thereto. This embodiment of the invention further includes Fabs containing additions, deletions, and variants of SEQ ID NO: 482 and/or SEQ ID NO: 502 which retain the binding specificity for PCSK9.

In one embodiment of the invention described herein (infra), Fab fragments may be produced by enzymatic digestion (e.g., papain) of Ab13. In another embodiment of the invention, anti-PCSK9 antibodies such as Ab13 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab13 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab14

In one embodiment, the invention includes antibodies and antibody fragments having binding specificity to PCSK9 that possess a heavy chain sequence comprising the sequence set forth below:

(SEQ ID NO: 521)
QEQLEESGGDLVKPEGSLTLTCTGSGFSFSSIAYMCWIRQAPGKGLEWI

GCIGSGSGNTYYANWAKGRFTISKSSSTTVTLQMTSLTAADTATYFCAS

DTNNGWLGQFNLWGQGTLVTVSSASTKGPSVFPLAPSSKSTSGGTAALG

CLVKDYFPEPVTVSWNSGALTSGVHTFPAVLQSSGLYSLSSVVTVPSSS

-continued

LGTQTYICNVNHKPSNTKVDKRVEPKSCDKTHTCPPCPAPELLGGPSVF

LFPPKPKDTLMISRTPEVTCVVVDVSHEDPEVKFNWYVDGVEVHNAKTK

PREEQYASTYRVVSVLTVLHQDWLNGKEYKCKVSNKALPAPIEKTISKA

KGQPREPQVYTLPPSREEMTKNQVSLTCLVKGFYPSDIAVEWESNGQPE

NNYKTTPPVLDSDGSFFLYSKLTVDKSRWQQGNVFSCSVMHEALHNHYT

QKSLSLSPGK.

In one embodiment, the invention includes antibodies and antibody fragments having binding specificity to PCSK9 that contain a variable heavy chain sequence comprising the sequence set forth below:

(SEQ ID NO: 522)
QEQLEESGGDLVKPEGSLTLTCTGSGFSFSSIAYMCWIRQAPGKGLEWI

GCIGSGSGNTYYANWAKGRFTISKSSSTTVTLQMTSLTAADTATYFCAS

DTNNGWLGQFNLWGQGTLVTVSS.

In another embodiment, the invention includes antibodies and antibody fragments having binding specificity to PCSK9 that possess the same epitopic specificity as Ab14 and which contain a constant heavy chain sequence comprising the sequence set forth below:

(SEQ ID NO: 530)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 541)
ADIVMTQTPASVSAAVGGTVTINCQASQSISSYLAWYQQKPGQPPKLLI

YRASTLASGVPSRFKGSGSGTQFTLTISDLECADAATYYCQGYYSVTTN

TYGNTFGGGTEVVVKRTVAAPSVFIFPPSDEQLKSGTASVVCLLNNFYP

REAKVQWKVDNALQSGNSQESVTEQDSKDSTYSLSSTLTLSKADYEKHK

VYACEVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 542)
ADIVMTQTPASVSAAVGGTVTINCQASQSISSYLAWYQQKPGQPPKLLI

YRASTLASGVPSRFKGSGSGTQFTLTISDLECADAATYYCQGYYSVTTN

TYGNTFGGGTEVVVK.

In another embodiment, the invention includes antibodies and antibody fragments having binding specificity to PCSK9 that bind the same epitope as Ab14 which contain a constant light chain sequence comprising the sequence set forth below:

(SEQ ID NO: 550)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

In another embodiment, the invention includes antibodies and antibody fragments having binding specificity to PCSK9 that contain one, two, or three of the polypeptide sequences of SEQ ID NO: 524; SEQ ID NO: 526; and SEQ ID NO: 528 which correspond to the complementarity-determining regions (CDRs, or hypervariable regions) of the heavy chain sequence of SEQ ID NO: 521 or which contain the variable heavy chain sequence of SEQ ID NO: 522, and/or which further contain one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or which contain the variable light chain sequence of SEQ ID NO: 542, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522, and/or one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 521 or SEQ ID NO: 522 or polypeptides that are at least 90% or 95% identical thereto. In another embodiment of the invention, antibody fragments of the invention comprise, or alternatively consist of, the polypeptide sequence of SEQ ID NO: 541 or SEQ ID NO: 542 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 524; SEQ ID NO: 526;

and SEQ ID NO: 528 which correspond to the complementarity-determining regions (CDRs, or hypervariable regions) of the heavy chain sequence of SEQ ID NO: 521 or the variable heavy chain sequence of SEQ ID NO: 522 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or the variable light chain sequence of SEQ ID NO: 542 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 522; the variable light chain region of SEQ ID NO: 542; the complementarity-determining regions (SEQ ID NO: 524; SEQ ID NO: 526; and SEQ ID NO: 528) of the variable heavy chain region of SEQ ID NO: 522; and the complementarity-determining regions (SEQ ID NO: 544; SEQ ID NO: 546; and SEQ ID NO: 548) of the variable light chain region of SEQ ID NO: 542 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 522; the variable light chain region of SEQ ID NO: 542; the framework regions (SEQ ID NO: 523; SEQ ID NO: 525; SEQ ID NO: 527; and SEQ ID NO: 529) of the variable heavy chain region of SEQ ID NO: 522; and the framework regions (SEQ ID NO: 543; SEQ ID NO: 545; SEQ ID NO: 547; and SEQ ID NO: 549) of the variable light chain region of SEQ ID NO: 542 or sequences that are at least 90% or 95% identical thereto.

In a particularly preferred embodiment of the invention, the anti-PCSK9 antibody is Ab14, comprising, or alternatively consisting of, SEQ ID NO: 521 and SEQ ID NO: 541, or an antibody or antibody fragment comprising the CDRs of Ab14 and having at least one of the biological activities set forth herein or is an anti-PCSK9 antibody that competes with Ab14 in binding PCSK9, preferably one containing sequences that are at least 90%, 95%, 96%, 97%, 98% or 99% identical to that of Ab14 or an antibody that binds to the same or overlapping epitope(s) on PCSK9 as Ab14.

In a further particularly preferred embodiment of the invention, antibody fragments comprise, or alternatively consist of, Fab (fragment antigen binding) fragments having binding specificity for PCSK9. With respect to antibody Ab14, the Fab fragment preferably includes the variable heavy chain sequence of SEQ ID NO: 522 and the variable light chain sequence of SEQ ID NO: 542 or sequences that are at least 90%, 95%, 96%, 97%, 98% or 99% identical thereto. This embodiment of the invention further includes Fabs containing additions, deletions, and variants of SEQ ID NO: 522 and/or SEQ ID NO: 542 which retain the binding specificity for PCSK9.

In one embodiment of the invention described herein (infra), Fab fragments may be produced by enzymatic digestion (e.g., papain) of Ab14. In another embodiment of the invention, anti-PCSK9 antibodies such as Ab14 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab14 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab15

In one embodiment, the invention includes antibodies and antibody fragments having binding specificity to PCSK9 that possess a heavy chain sequence comprising the sequence set forth below:

(SEQ ID NO: 561)
QEQLEESGGDLVKPEGSLTLTCTASGFSFSSSYWICWVRQAPGKGLEWI

ACIDAGNSGSTYYASWAKGRFTISKASSTTVTLQMTSLTAADTATYFCA

SDLNDGWLGQFNLWGPGTLVTVSSASTKGPSVFPLAPSSKSTSGGTAAL

GCLVKDYFPEPVTVSWNSGALTSGVHTFPAVLQSSGLYSLSSVVTVPSS

SLGTQTYICNVNHKPSNTKVDKRVEPKSCDKTHTCPPCPAPELLGGPSV

FLFPPKPKDTLMISRTPEVTCVVVDVSHEDPEVKFNWYVDGVEVHNAKT

KPREEQYASTYRVVSVLTVLHQDWLNGKEYKCKVSNKALPAPIEKTISK

AKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHY

TQKSLSLSPGK.

In one embodiment, the invention includes antibodies and antibody fragments having binding specificity to PCSK9 that contain a variable heavy chain sequence comprising the sequence set forth below:

(SEQ ID NO: 562)
QEQLEESGGDLVKPEGSLTLTCTASGFSFSSSYWICWVRQAPGKGLEWI

ACIDAGNSGSTYYASWAKGRFTISKASSTTVTLQMTSLTAADTATYFCA

SDLNDGWLGQFNLWGPGTLVTVSS.

In another embodiment, the invention includes antibodies and antibody fragments having binding specificity to PCSK9 that possess the same epitopic specificity as Ab15 and which contain a constant heavy chain sequence comprising the sequence set forth below:

(SEQ ID NO: 570)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 581)
ANIVMTQTPSPVSGAVGGTVTIKCQASQSISDYLAWYQQKPGQPPKLLI

YRASTLASGVPSRFRGSGSGTEYTLTITDLECADAATYYCQSYYSVTTN

TYGNTFGGGTEVVVKRTVAAPSVFIFPPSDEQLKSGTASVVCLLNNFYP

REAKVQWKVDNALQSGNSQESVTEQDSKDSTYSLSSTLTLSKADYEKHK

VYACEVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 582)
ANIVMTQTPSPVSGAVGGTVTIKCQASQSISDYLAWYQQKPGQPPKLLI

YRASTLASGVPSRFRGSGSGTEYTLTITDLECADAATYYCQSYYSVTTN

TYGNTFGGGTEVVVK.

In another embodiment, the invention includes antibodies and antibody fragments having binding specificity to PCSK9 that bind the same epitope as Ab15 which contain a constant light chain sequence comprising the sequence set forth below:

(SEQ ID NO: 590)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

In another embodiment, the invention includes antibodies and antibody fragments having binding specificity to PCSK9 that contain one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or which contain the variable heavy chain sequence of SEQ ID NO: 562, and/or which further contain one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or which contain the variable light chain sequence of SEQ ID NO: 582, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562, and/or one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 561 or SEQ ID NO: 562 or polypeptides that are at least 90% or 95% identical thereto. In another embodiment of the invention, antibody fragments of the invention comprise, or alternatively consist of, the polypeptide sequence of SEQ ID NO: 581 or SEQ ID NO: 582 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or the variable heavy chain sequence of SEQ ID NO: 562 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or the variable light chain sequence of SEQ ID NO: 582 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 562; the variable light chain region of SEQ ID NO: 582; the complementarity-determining regions (SEQ ID NO: 564; SEQ ID NO: 566; and SEQ ID NO: 568) of the variable heavy chain region of SEQ ID NO: 562; and the complementarity-determining regions (SEQ ID NO: 584; SEQ ID NO: 586; and SEQ ID NO: 588) of the variable light chain region of SEQ ID NO: 582 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 562; the variable light chain region of SEQ ID NO: 582; the framework regions (SEQ ID NO: 563; SEQ ID NO: 565; SEQ ID NO: 567; and SEQ ID NO: 569) of the variable heavy chain region of SEQ ID NO: 562; and the framework regions (SEQ ID NO: 583; SEQ ID NO: 585; SEQ ID NO: 587; and SEQ ID NO: 589) of the variable light chain region of SEQ ID NO: 582 or sequences that are at least 90% or 95% identical thereto.

In a particularly preferred embodiment of the invention, the anti-PCSK9 antibody is Ab15, comprising, or alternatively consisting of, SEQ ID NO: 561 and SEQ ID NO: 581, or an antibody or antibody fragment comprising the CDRs of Ab15 and having at least one of the biological activities set forth herein or is an anti-PCSK9 antibody that competes with Ab15 in binding PCSK9, preferably one containing sequences that are at least 90%, 95%, 96%, 97%, 98% or 99% identical to that of Ab15 or an antibody that binds to the same or overlapping epitope(s) on PCSK9 as Ab15.

In a further particularly preferred embodiment of the invention, antibody fragments comprise, or alternatively consist of, Fab (fragment antigen binding) fragments having binding specificity for PCSK9. With respect to antibody Ab15, the Fab fragment preferably includes the variable heavy chain sequence of SEQ ID NO: 562 and the variable light chain sequence of SEQ ID NO: 582 or sequences that are at least 90%, 95%, 96%, 97%, 98% or 99% identical thereto. This embodiment of the invention further includes Fabs containing additions, deletions, and variants of SEQ ID NO: 562 and/or SEQ ID NO: 582 which retain the binding specificity for PCSK9.

In one embodiment of the invention described herein (infra), Fab fragments may be produced by enzymatic digestion (e.g., papain) of Ab15. In another embodiment of the invention, anti-PCSK9 antibodies such as Ab15 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab15 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab16

In one embodiment, the invention includes antibodies and antibody fragments having binding specificity to PCSK9 that possess a heavy chain sequence comprising the sequence set forth below:

(SEQ ID NO: 601)
QEQLVESGGGLVQPEGSLTLTCTASGFSFSSDYWICWVRQAPGKGLEWIG

CIRDGGGSYYANWAKGRLTISMTSSTTVGLKMTSLTAADTATYFCASDIN

DGWLGQFNLWGPGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 602)
QEQLVESGGGLVQPEGSLTLTCTASGFSFSSDYWICWVRQAPGKGLEWIG

CIRDGGGSYYANWAKGRLTISMTSSTTVGLKMTSLTAADTATYFCASDIN

DGWLGQFNLWGPGTLVTVSS.

In another embodiment, the invention includes antibodies and antibody fragments having binding specificity to PCSK9 that possess the same epitopic specificity as Ab16 and which contain a constant heavy chain sequence comprising the sequence set forth below:

(SEQ ID NO: 610)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 621)
ADIVMTQTPASVEAAVGGTVTIKCQASQSISSYLAWYQQKPGQPPKLLIY

RASTLASGVPSRFSGSGSGTEFTLTISDLECADAATYYCQSYYSVTTVTY

GNTFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 622)
ADIVMTQTPASVEAAVGGTVTIKCQASQSISSYLAWYQQKPGQPPKLLIY

RASTLASGVPSRFSGSGSGTEFTLTISDLECADAATYYCQSYYSVTTVTY

GNTFGGGTEVVVK.

In another embodiment, the invention includes antibodies and antibody fragments having binding specificity to PCSK9 that bind the same epitope as Ab16 which contain a constant light chain sequence comprising the sequence set forth below:

(SEQ ID NO: 630)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or which contain the variable heavy chain sequence of SEQ ID NO: 602, and/or which further contain one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or which contain the variable light chain sequence of SEQ ID NO: 622, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602, and/or one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 601 or SEQ ID NO: 602 or polypeptides that are at least 90% or 95% identical thereto. In another embodiment of the invention, antibody fragments of the invention comprise, or alternatively consist of, the polypeptide sequence of SEQ ID NO: 621 or SEQ ID NO: 622 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or the variable heavy chain sequence of SEQ ID NO: 602 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or the variable light chain sequence of SEQ ID NO: 622 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 602; the variable light chain region of SEQ ID NO: 622; the complementarity-determining regions (SEQ ID NO: 604; SEQ ID NO: 606; and SEQ ID NO: 608) of the variable heavy chain region of SEQ ID NO: 602; and the complementarity-determining regions (SEQ ID NO: 624; SEQ ID NO: 626; and SEQ ID NO: 628) of the variable light chain region of SEQ ID NO: 622 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 602; the variable light chain region of SEQ ID NO: 622; the framework regions (SEQ ID NO: 603; SEQ ID NO: 605; SEQ ID NO: 607; and SEQ ID NO: 609) of the variable heavy chain region of SEQ ID NO: 602; and the framework regions (SEQ ID NO: 623; SEQ ID NO: 625; SEQ ID NO: 627; and SEQ ID NO: 629) of the variable light chain region of SEQ ID NO: 622 or sequences that are at least 90% or 95% identical thereto.

In a particularly preferred embodiment of the invention, the anti-PCSK9 antibody is Ab16, comprising, or alternatively consisting of, SEQ ID NO: 601 and SEQ ID NO: 621, or an antibody or antibody fragment comprising the CDRs of Ab16 and having at least one of the biological activities set forth herein or is an anti-PCSK9 antibody that competes with Ab16 in binding PCSK9, preferably one containing sequences that are at least 90%, 95%, 96%, 97%, 98% or 99% identical to that of Ab16 or an antibody that binds to the same or overlapping epitope(s) on PCSK9 as Ab16.

In a further particularly preferred embodiment of the invention, antibody fragments comprise, or alternatively consist of, Fab (fragment antigen binding) fragments having binding specificity for PCSK9. With respect to antibody Ab16, the Fab fragment preferably includes the variable heavy chain sequence of SEQ ID NO: 602 and the variable light chain sequence of SEQ ID NO: 622 or sequences that are at least 90%, 95%, 96%, 97%, 98% or 99% identical thereto. This embodiment of the invention further includes Fabs containing additions, deletions, and variants of SEQ ID NO: 602 and/or SEQ ID NO: 622 which retain the binding specificity for PCSK9.

In one embodiment of the invention described herein (infra), Fab fragments may be produced by enzymatic digestion (e.g., papain) of Ab16. In another embodiment of the invention, anti-PCSK9 antibodies such as Ab16 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab16 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab17

In one embodiment, the invention includes antibodies and antibody fragments having binding specificity to PCSK9 that possess a heavy chain sequence comprising the sequence set forth below:

```
                                           (SEQ ID NO: 641)
QEQLEESGGDLVKPEGSLTLTCTASGFSFSSSYWICWVRQAPGKGLEWIG

CIRPGSADYYASWAKGRFTISRASSSTVTLQMTSLTAADTATYFCASDIN

DGWLGQFNLWGPGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPG

K.
```

In one embodiment, the invention includes antibodies and antibody fragments having binding specificity to PCSK9 that contain a variable heavy chain sequence comprising the sequence set forth below:

```
                                           (SEQ ID NO: 642)
QEQLEESGGDLVKPEGSLTLTCTASGFSFSSSYWICWVRQAPGKGLEWIG

CIRPGSADYYASWAKGRFTISRASSSTVTLQMTSLTAADTATYFCASDIN

DGWLGQFNLWGPGTLVTVSS.
```

In another embodiment, the invention includes antibodies and antibody fragments having binding specificity to PCSK9 that possess the same epitopic specificity as Ab17 and which contain a constant heavy chain sequence comprising the sequence set forth below:

```
                                           (SEQ ID NO: 650)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                           (SEQ ID NO: 661)
ADVVMTQTPASVEAAVGGTVTIKCQASLSIADYLAWYLQKPGQPPKLLIY

RASTLASGVPSRFKGSGSGTEYTLTISDLECADAATYYCQSYYSVTTNTY

GNTFGGGTEVVVKRTVAAPSVFIFPPSDEQLKSGTASVVCLLNNFYPREA
```

-continued
KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to PCSK9 that contain a variable light chain sequence comprising the sequence set forth below:

```
                                           (SEQ ID NO: 662)
ADVVMTQTPASVEAAVGGTVTIKCQASLSIADYLAWYLQKPGQPPKLLIY

RASTLASGVPSRFKGSGSGTEYTLTISDLECADAATYYCQSYYSVTTNTY

GNTFGGGTEVVVK.
```

In another embodiment, the invention includes antibodies and antibody fragments having binding specificity to PCSK9 that bind the same epitope as Ab17 which contain a constant light chain sequence comprising the sequence set forth below:

```
                                           (SEQ ID NO: 670)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.
```

In another embodiment, the invention includes antibodies and antibody fragments having binding specificity to PCSK9 that contain one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or which contain the variable heavy chain sequence of SEQ ID NO: 642, and/or which further contain one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or which contain the variable light chain sequence of SEQ ID NO: 662, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642, and/or one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 641 or SEQ ID NO: 642 or polypeptides that are at least 90% or 95% identical thereto. In another embodiment of the invention, antibody fragments of the invention comprise, or alternatively consist of, the polypeptide sequence of SEQ ID NO: 661 or SEQ ID NO: 662 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or the variable heavy chain sequence of SEQ ID NO: 642 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or the variable light chain sequence of SEQ ID NO: 662 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 642; the variable light chain region of SEQ ID NO: 662; the complementarity-determining regions (SEQ ID NO: 644; SEQ ID NO: 646; and SEQ ID NO: 648) of the variable heavy chain region of SEQ ID NO: 642; and the complementarity-determining regions (SEQ ID NO: 664; SEQ ID NO: 666; and SEQ ID NO: 668) of the variable light chain region of SEQ ID NO: 662 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 642; the variable light chain region of SEQ ID NO: 662; the framework regions (SEQ ID NO: 643; SEQ ID NO: 645; SEQ ID NO: 647; and SEQ ID NO: 649) of the variable heavy chain region of SEQ ID NO: 642; and the framework regions (SEQ ID NO: 663; SEQ ID NO: 665; SEQ ID NO: 667; and SEQ ID NO: 669) of the variable light chain region of SEQ ID NO: 662 or sequences that are at least 90% or 95% identical thereto.

In a particularly preferred embodiment of the invention, the anti-PCSK9 antibody is Ab17, comprising, or alternatively consisting of, SEQ ID NO: 641 and SEQ ID NO: 661, or an antibody or antibody fragment comprising the CDRs of Ab17 and having at least one of the biological activities set forth herein or is an anti-PCSK9 antibody that competes with Ab17 in binding PCSK9, preferably one containing sequences that are at least 90%, 95%, 96%, 97%, 98% or 99% identical to that of Ab17 or an antibody that binds to the same or overlapping epitope(s) on PCSK9 as Ab17.

In a further particularly preferred embodiment of the invention, antibody fragments comprise, or alternatively consist of, Fab (fragment antigen binding) fragments having binding specificity for PCSK9. With respect to antibody Ab17, the Fab fragment preferably includes the variable heavy chain sequence of SEQ ID NO: 642 and the variable light chain sequence of SEQ ID NO: 662 or sequences that are at least 90%, 95%, 96%, 97%, 98% or 99% identical thereto. This embodiment of the invention further includes Fabs containing additions, deletions, and variants of SEQ ID NO: 642 and/or SEQ ID NO: 662 which retain the binding specificity for PCSK9.

In one embodiment of the invention described herein (infra), Fab fragments may be produced by enzymatic digestion (e.g., papain) of Ab17. In another embodiment of the invention, anti-PCSK9 antibodies such as Ab17 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab17 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab18

In one embodiment, the invention includes antibodies and antibody fragments having binding specificity to PCSK9 that possess a heavy chain sequence comprising the sequence set forth below:

```
                                        (SEQ ID NO: 681)
EVQLVESGGGLVQPGGSLRLSCAASGFTVSSNYWICWVRQAPGKGLEWIG

CIRDGGGTYYASSAKGRFTISRDNSKNTLYLQMNSLRAEDTAVYYCASDI

NDGWLGQFNLWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDARVEPKSCDKTHTCPPCPAPELLGGPSVFLFPPK
```
-continued
```
PKDTLMISRTPEVTCVVVDVSHEDPEVKFNWYVDGVEVHNAKTKPREEQY

ASTYRVVSVLTVLHQDWLNGKEYKCKVSNKALPAPIEKTISKAKGQPREP

QVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

K.
```

In one embodiment, the invention includes antibodies and antibody fragments having binding specificity to PCSK9 that contain a variable heavy chain sequence comprising the sequence set forth below:

```
                                        (SEQ ID NO: 682)
EVQLVESGGGLVQPGGSLRLSCAASGFTVSSNYWICWVRQAPGKGLEWIG

CIRDGGGTYYASSAKGRFTISRDNSKNTLYLQMNSLRAEDTAVYYCASDI

NDGWLGQFNLWGQGTLVTVSS.
```

In another embodiment, the invention includes antibodies and antibody fragments having binding specificity to PCSK9 that possess the same epitopic specificity as Ab18 and which contain a constant heavy chain sequence comprising the sequence set forth below:

```
                                        (SEQ ID NO: 690)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                        (SEQ ID NO: 701)
ADIVMTQSPSSLSASVGDRVTIKCQASQSISAYLAWYQQKPGKVPKLLIY

RAYTLASGVPSRFSGSGSGTDFTLTISSLQPEDVATYYCQSYYSVTTNTY

GNTFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.
```

In another embodiment, the invention includes antibodies and antibody fragments having binding specificity to PCSK9 that contain a variable light chain sequence comprising the sequence set forth below:

```
                                        (SEQ ID NO: 702)
ADIVMTQSPSSLSASVGDRVTIKCQASQSISAYLAWYQQKPGKVPKLLIY

RAYTLASGVPSRFSGSGSGTDFTLTISSLQPEDVATYYCQSYYSVTTNTY

GNTFGGGTKVEIK.
```

In another embodiment, the invention includes antibodies and antibody fragments having binding specificity to PCSK9 that bind the same epitope as Ab18 which contain a constant light chain sequence comprising the sequence set forth below: RTVAAPSVFIFPPSDEQLKSGTASV-VCLLNNFYPREAKVQWKVDNALQSGNSQES VTE-QDSKDSTYSLSSTLTLSKADYEKHKVY-ACEVTHQGLSSPVTKSFNRGEC (SEQ ID NO: 710).

In another embodiment, the invention includes antibodies and antibody fragments having binding specificity to PCSK9 that contain one, two, or three of the polypeptide sequences of SEQ ID NO: 684; SEQ ID NO: 686; and SEQ ID NO: 688 which correspond to the complementarity-determining regions (CDRs, or hypervariable regions) of the heavy chain sequence of SEQ ID NO: 681 or which contain the variable heavy chain sequence of SEQ ID NO: 682, and/or which further contain one, two, or three of the polypeptide sequences of SEQ ID NO: 704; SEQ ID NO: 706; and SEQ ID NO: 708 which correspond to the complementarity-determining regions (CDRs, or hypervariable regions) of the light chain sequence of SEQ ID NO: 701 or which contain the variable light chain sequence of SEQ ID NO: 702, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 683; SEQ ID NO: 685; SEQ ID NO: 687; and SEQ ID NO: 689 which correspond to the framework regions (FRs or constant regions) of the heavy chain sequence of SEQ ID NO: 681 or the variable heavy chain sequence of SEQ ID NO: 682, and/or one, two, three, or four of the polypeptide sequences of SEQ ID NO: 703; SEQ ID NO: 705; SEQ ID NO: 707; and SEQ ID NO: 709 which correspond to the framework regions (FRs or constant regions) of the light chain sequence of SEQ ID NO: 701 or the variable light chain sequence of SEQ ID NO: 702, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 681 or SEQ ID NO: 682 or polypeptides that are at least 90% or 95% identical thereto. In another embodiment of the invention, antibody fragments of the invention comprise, or alternatively consist of, the polypeptide sequence of SEQ ID NO: 701 or SEQ ID NO: 702 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 684; SEQ ID NO: 686; and SEQ ID NO: 688 which correspond to the complementarity-determining regions (CDRs, or hypervariable regions) of the heavy chain sequence of SEQ ID NO: 681 or the variable heavy chain sequence of SEQ ID NO: 682 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 704; SEQ ID NO: 706; and SEQ ID NO: 708 which correspond to the complementarity-determining regions (CDRs, or hypervariable regions) of the light chain sequence of SEQ ID NO: 701 or the variable light chain sequence of SEQ ID NO: 702 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 683; SEQ ID NO: 685; SEQ ID NO: 687; and SEQ ID NO: 689 which correspond to the framework regions (FRs or constant regions) of the heavy chain sequence of SEQ ID NO: 681 or the variable heavy chain sequence of SEQ ID NO: 682 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 703; SEQ ID NO: 705; SEQ ID NO: 707; and SEQ ID NO: 709 which correspond to the framework regions (FRs or constant regions) of the light chain sequence of SEQ ID NO: 701 or the variable light chain sequence of SEQ ID NO: 702 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 682; the variable light chain region of SEQ ID NO: 702; the complementarity-determining regions (SEQ ID NO: 684; SEQ ID NO: 686; and SEQ ID NO: 688) of the variable heavy chain region of SEQ ID NO: 682; and the complementarity-determining regions (SEQ ID NO: 704; SEQ ID NO: 706; and SEQ ID NO: 708) of the variable light chain region of SEQ ID NO: 702 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 682; the variable light chain region of SEQ ID NO: 702; the framework regions (SEQ ID NO: 683; SEQ ID NO: 685; SEQ ID NO: 687; and SEQ ID NO: 689) of the variable heavy chain region of SEQ ID NO: 682; and the framework regions (SEQ ID NO: 703; SEQ ID NO: 705; SEQ ID NO: 707; and SEQ ID NO: 709) of the variable light chain region of SEQ ID NO: 702 or sequences that are at least 90% or 95% identical thereto.

In a particularly preferred embodiment of the invention, the anti-PCSK9 antibody is Ab18, comprising, or alternatively consisting of, SEQ ID NO: 681 and SEQ ID NO: 701, or an antibody or antibody fragment comprising the CDRs of Ab18 and having at least one of the biological activities set forth herein or is an anti-PCSK9 antibody that competes with Ab18 in binding PCSK9, preferably one containing sequences that are at least 90%, 95%, 96%, 97%, 98% or 99% identical to that of Ab18 or an antibody that binds to the same or overlapping epitope(s) on PCSK9 as Ab18.

In a further particularly preferred embodiment of the invention, antibody fragments comprise, or alternatively consist of, Fab (fragment antigen binding) fragments having binding specificity for PCSK9. With respect to antibody Ab18, the Fab fragment preferably includes the variable heavy chain sequence of SEQ ID NO: 682 and the variable light chain sequence of SEQ ID NO: 702 or sequences that are at least 90%, 95%, 96%, 97%, 98% or 99% identical thereto. This embodiment of the invention further includes Fabs containing additions, deletions, and variants of SEQ ID NO: 682 and/or SEQ ID NO: 702 which retain the binding specificity for PCSK9.

In one embodiment of the invention described herein (infra), Fab fragments may be produced by enzymatic digestion (e.g., papain) of Ab18. In another embodiment of the invention, anti-PCSK9 antibodies such as Ab18 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab18 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab19

In one embodiment, the invention includes antibodies and antibody fragments having binding specificity to PCSK9 that possess a heavy chain sequence comprising the sequence set forth below:

```
                                            (SEQ ID NO: 721)
EVQLVESGGGLVQPGGSLRLSCAASGIDLSSYAMGWVRQAPGKGLEYIGI

IVSYGPTYYASWAKGRFTISRDNSKNTVYLQMNSLRAEDTATYFCARDLD

AQSSGYYGAFNIWGQGTLVTVSSASTKGPSVFPLAPSSKSTSGGTAALGC

LVKDYFPEPVTVSWNSGALTSGVHTFPAVLQSSGLYSLSSVVTVPSSSLG

TQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREE

QYASTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTT

PPVLDSDGSFFLYSKLTVDKSRWQQGNVFSCSVMHEALHNHYTQKSLSLS

PGK.
```

In one embodiment, the invention includes antibodies and antibody fragments having binding specificity to PCSK9 that contain a variable heavy chain sequence comprising the sequence set forth below:

```
                                            (SEQ ID NO: 722)
EVQLVESGGGLVQPGGSLRLSCAASGIDLSSYAMGWVRQAPGKGLEYIGI

IVSYGPTYYASWAKGRFTISRDNSKNTVYLQMNSLRAEDTATYFCARDLD

AQSSGYYGAFNIWGQGTLVTVSS.
```

In another embodiment, the invention includes antibodies and antibody fragments having binding specificity to PCSK9 that possess the same epitopic specificity as Ab19 and which contain a constant heavy chain sequence comprising the sequence set forth below:

```
                                            (SEQ ID NO: 730)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to PCSK9 that contain a light chain sequence comprising the sequence set forth below:

```
                                            (SEQ ID NO: 741)
DIQMTQSPSTLSASVGDRVTITCQASQSISTALAWYQQKPGKAPKLLIYA

ASPLASGVPSRFSGSGSGTEFTLTISSLQPDDFATYYCQSYYGSSNIAFG

GGTKVEIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC.
```

In another embodiment, the invention includes antibodies and antibody fragments having binding specificity to PCSK9 that contain a variable light chain sequence comprising the sequence set forth below:

```
                                            (SEQ ID NO: 742)
DIQMTQSPSTLSASVGDRVTITCQASQSISTALAWYQQKPGKAPKLLIYA

ASPLASGVPSRFSGSGSGTEFTLTISSLQPDDFATYYCQSYYGSSNIAFG

GGTKVEIK.
```

In another embodiment, the invention includes antibodies and antibody fragments having binding specificity to PCSK9 that bind the same epitope as Ab19 which contain a constant light chain sequence comprising the sequence set forth below:

```
                                            (SEQ ID NO: 750)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.
```

In another embodiment, the invention includes antibodies and antibody fragments having binding specificity to PCSK9 that contain one, two, or three of the polypeptide sequences of SEQ ID NO: 724; SEQ ID NO: 726; and SEQ ID NO: 728 which correspond to the complementarity-determining regions (CDRs, or hypervariable regions) of the heavy chain sequence of SEQ ID NO: 721 or which contain the variable heavy chain sequence of SEQ ID NO: 722, and/or which further contain one, two, or three of the polypeptide sequences of SEQ ID NO: 744; SEQ ID NO: 746; and SEQ ID NO: 748 which correspond to the complementarity-determining regions (CDRs, or hypervariable regions) of the light chain sequence of SEQ ID NO: 741 or which contain the variable light chain sequence of SEQ ID NO: 742, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 723; SEQ ID NO: 725; SEQ ID NO: 727; and SEQ ID NO: 729 which correspond to the framework regions (FRs or constant regions) of the heavy chain sequence of SEQ ID NO: 721 or the variable heavy chain sequence of SEQ ID NO: 722, and/or one, two, three, or four of the polypeptide sequences of SEQ ID NO: 743; SEQ ID NO: 745; SEQ ID NO: 747; and SEQ ID NO: 749 which correspond to the framework regions (FRs or constant regions) of the light chain sequence of SEQ ID NO: 741 or the variable light chain sequence of SEQ ID NO: 742, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 721 or SEQ ID NO: 722 or polypeptides that are at least 90% or 95% identical thereto. In another embodiment of the invention, antibody fragments of the invention comprise, or alternatively consist of, the polypeptide sequence of SEQ ID NO: 741 or SEQ ID NO: 742 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 724; SEQ ID NO: 726; and SEQ ID NO: 728 which correspond to the complementarity-determining regions (CDRs, or hypervariable regions) of the heavy chain sequence of SEQ ID NO: 721 or the variable heavy chain sequence of SEQ ID NO: 722 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 744; SEQ ID NO: 746; and SEQ ID NO: 748 which correspond to the complementarity-determining regions (CDRs, or hypervariable regions) of the light chain sequence of SEQ ID NO: 741 or the variable light chain sequence of SEQ ID NO: 742 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 723; SEQ ID NO: 725; SEQ ID NO: 727; and SEQ ID NO: 729 which correspond to the framework regions (FRs or constant regions) of the heavy chain sequence of SEQ ID NO: 721 or the variable heavy chain sequence of SEQ ID NO: 722 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 743; SEQ ID NO: 745; SEQ ID NO: 747; and SEQ ID NO: 749 which correspond to the framework regions (FRs or constant regions) of the light chain sequence of SEQ ID NO: 741 or the variable light chain sequence of SEQ ID NO: 742 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 722; the variable light chain region of SEQ ID NO: 742; the complementarity-determining regions (SEQ ID NO: 724; SEQ ID NO: 726; and SEQ ID NO: 728) of the variable heavy chain region of SEQ ID NO: 722; and the complementarity-determining regions (SEQ ID NO: 744; SEQ ID NO: 746; and SEQ ID NO: 748) of the variable light chain region of SEQ ID NO: 742 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 722; the variable light chain region of SEQ ID NO: 742; the framework regions (SEQ ID NO: 723; SEQ ID NO: 725; SEQ ID NO: 727; and SEQ ID NO: 729) of the variable heavy chain region of SEQ ID NO: 722; and the framework regions (SEQ ID NO: 743; SEQ ID NO: 745; SEQ ID NO: 747; and SEQ ID NO: 749) of the variable light chain region of SEQ ID NO: 742 or sequences that are at least 90% or 95% identical thereto.

In a particularly preferred embodiment of the invention, the anti-PCSK9 antibody is Ab19, comprising, or alternatively consisting of, SEQ ID NO: 721 and SEQ ID NO: 741, or an antibody or antibody fragment comprising the CDRs of Ab19 and having at least one of the biological activities set forth herein or is an anti-PCSK9 antibody that competes with Ab19 in binding PCSK9, preferably one containing sequences that are at least 90%, 95%, 96%, 97%, 98% or 99% identical to that of Ab19 or an antibody that binds to the same or overlapping epitope(s) on PCSK9 as Ab19.

In a further particularly preferred embodiment of the invention, antibody fragments comprise, or alternatively consist of, Fab (fragment antigen binding) fragments having binding specificity for PCSK9. With respect to antibody Ab19, the Fab fragment preferably includes the variable heavy chain sequence of SEQ ID NO: 722 and the variable light chain sequence of SEQ ID NO: 742 or sequences that are at least 90%, 95%, 96%, 97%, 98% or 99% identical thereto. This embodiment of the invention further includes Fabs containing additions, deletions, and variants of SEQ ID NO: 722 and/or SEQ ID NO: 742 which retain the binding specificity for PCSK9.

In one embodiment of the invention described herein (infra), Fab fragments may be produced by enzymatic digestion (e.g., papain) of Ab19. In another embodiment of the invention, anti-PCSK9 antibodies such as Ab19 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab19 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab20

In one embodiment, the invention includes antibodies and antibody fragments having binding specificity to PCSK9 that possess a heavy chain sequence comprising the sequence set forth below:

(SEQ ID NO: 761)
EVQLVESGGGLVQPGGSLRLSCAASGIDLSSYAMGWVRQAPGKGLEYIGI

IVSYGPTYYASWAKGRFTISRDNSKSTVYLQMNSLRAEDTATYFCARDLD

AQSSGYYGAFNIWGQGTLVTVSSASTKGPSVFPLAPSSKSTSGGTAALGC

LVKDYFPEPVTVSWNSGALTSGVHTFPAVLQSSGLYSLSSVVTVPSSSLG

TQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREE

QYASTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTT

PPVLDSDGSFFLYSKLTVDKSRWQQGNVFSCSVMHEALHNHYTQKSLSLS

PGK.

In one embodiment, the invention includes antibodies and antibody fragments having binding specificity to PCSK9 that contain a variable heavy chain sequence comprising the sequence set forth below:

(SEQ ID NO: 762)
EVQLVESGGGLVQPGGSLRLSCAASGIDLSSYAMGWVRQAPGKGLEYIGI

IVSYGPTYYASWAKGRFTISRDNSKSTVYLQMNSLRAEDTATYFCARDLD

AQSSGYYGAFNIWGQGTLVTVSS.

In another embodiment, the invention includes antibodies and antibody fragments having binding specificity to PCSK9 that possess the same epitopic specificity as Ab20 and which contain a constant heavy chain sequence comprising the sequence set forth below:

(SEQ ID NO: 770)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

-continued
LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 781)
DIQMTQSPSTLSASVGDRVTITCQASQSISTALAWYQQKPGKAPKLLIYA

ASPLASGVPSRFSGSGSGTEFTLTISSLQPDDFATYYCQSYYGSSNIAFG

GGTKVEIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC.

In another embodiment, the invention includes antibodies and antibody fragments having binding specificity to PCSK9 that contain a variable light chain sequence comprising the sequence set forth below:

(SEQ ID NO: 782)
DIQMTQSPSTLSASVGDRVTITCQASQSISTALAWYQQKPGKAPKLLIYA

ASPLASGVPSRFSGSGSGTEFTLTISSLQPDDFATYYCQSYYGSSNIAFG

GGTKVEIK.

In another embodiment, the invention includes antibodies and antibody fragments having binding specificity to PCSK9 that bind the same epitope as Ab20 which contain a constant light chain sequence comprising the sequence set forth below:

(SEQ ID NO: 790)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 764; SEQ ID NO: 766; and SEQ ID NO: 768 which correspond to the complementarity-determining regions (CDRs, or hypervariable regions) of the heavy chain sequence of SEQ ID NO: 761 or which contain the variable heavy chain sequence of SEQ ID NO: 762, and/or which further contain one, two, or three of the polypeptide sequences of SEQ ID NO: 784; SEQ ID NO: 786; and SEQ ID NO: 788 which correspond to the complementarity-determining regions (CDRs, or hypervariable regions) of the light chain sequence of SEQ ID NO: 781 or which contain the variable light chain sequence of SEQ ID NO: 782, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 763; SEQ ID NO: 765; SEQ ID NO: 767; and SEQ ID NO: 769 which correspond to the framework regions (FRs or constant regions) of the heavy chain sequence of SEQ ID NO: 761 or the variable heavy chain sequence of SEQ ID NO: 762, and/or one, two, three, or four of the polypeptide sequences of SEQ ID NO: 783; SEQ ID NO: 785; SEQ ID NO: 787; and SEQ ID NO: 789 which correspond to the framework regions (FRs or constant regions) of the light chain sequence of SEQ ID NO: 781 or the variable light chain sequence of SEQ ID NO: 782, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 761 or SEQ ID NO: 762 or polypeptides that are at least 90% or 95% identical thereto. In another embodiment of the invention, antibody fragments of the invention comprise, or alternatively consist of, the polypeptide sequence of SEQ ID NO: 781 or SEQ ID NO: 782 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 764; SEQ ID NO: 766; and SEQ ID NO: 768 which correspond to the complementarity-determining regions (CDRs, or hypervariable regions) of the heavy chain sequence of SEQ ID NO: 761 or the variable heavy chain sequence of SEQ ID NO: 762 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 784; SEQ ID NO: 786; and SEQ ID NO: 788 which correspond to the complementarity-determining regions (CDRs, or hypervariable regions) of the light chain sequence of SEQ ID NO: 781 or the variable light chain sequence of SEQ ID NO: 782 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 763; SEQ ID NO: 765; SEQ ID NO: 767; and SEQ ID NO: 769 which correspond to the framework regions (FRs or constant regions) of the heavy chain sequence of SEQ ID NO: 761 or the variable heavy chain sequence of SEQ ID NO: 762 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 783; SEQ ID NO: 785; SEQ ID NO: 787; and SEQ ID NO: 789 which correspond to the framework regions (FRs or constant regions) of the light chain sequence of SEQ ID NO: 781 or the variable light chain sequence of SEQ ID NO: 782 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 762; the variable light chain region of SEQ ID NO: 782; the complementarity-determining regions (SEQ ID NO: 764; SEQ ID NO: 766; and SEQ ID NO: 768) of the variable heavy chain region of SEQ ID NO: 762; and the complementarity-determining regions (SEQ ID NO: 784; SEQ ID NO: 786; and SEQ ID NO: 788) of the variable light chain region of SEQ ID NO: 782 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 762; the variable light chain region of SEQ ID NO: 782; the framework regions (SEQ ID NO: 763; SEQ ID NO: 765; SEQ ID NO: 767; and SEQ ID NO: 769) of the variable heavy chain region of SEQ ID NO: 762; and the framework regions (SEQ ID NO: 783; SEQ ID NO: 785; SEQ ID NO: 787; and SEQ ID NO: 789) of the variable light chain region of SEQ ID NO: 782 or sequences that are at least 90% or 95% identical thereto.

In a particularly preferred embodiment of the invention, the anti-PCSK9 antibody is Ab20, comprising, or alternatively consisting of, SEQ ID NO: 761 and SEQ ID NO: 781, or an antibody or antibody fragment comprising the CDRs of Ab20 and having at least one of the biological activities set forth herein or is an anti-PCSK9 antibody that competes with Ab20 in binding PCSK9, preferably one containing sequences that are at least 90%, 95%, 96%, 97%, 98% or 99% identical to that of Ab20 or an antibody that binds to the same or overlapping epitope(s) on PCSK9 as Ab20.

In a further particularly preferred embodiment of the invention, antibody fragments comprise, or alternatively consist of, Fab (fragment antigen binding) fragments having binding specificity for PCSK9. With respect to antibody Ab20, the Fab fragment preferably includes the variable heavy chain sequence of SEQ ID NO: 762 and the variable light chain sequence of SEQ ID NO: 782 or sequences that are at least 90%, 95%, 96%, 97%, 98% or 99% identical thereto. This embodiment of the invention further includes Fabs containing additions, deletions, and variants of SEQ ID NO: 762 and/or SEQ ID NO: 782 which retain the binding specificity for PCSK9.

In one embodiment of the invention described herein (infra), Fab fragments may be produced by enzymatic digestion (e.g., papain) of Ab20. In another embodiment of the invention, anti-PCSK9 antibodies such as Ab20 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab20 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab21

In one embodiment, the invention includes antibodies and antibody fragments having binding specificity to PCSK9 that possess a heavy chain sequence comprising the sequence set forth below:

(SEQ ID NO: 801)
QSVEESGGRLVTPGTPLTLTCTVSGFSLSSYAMNWVRQAPGKGLEWIGAI

RSSGATFFASWVNGRFTISKTSTTVDLKITSPTPEDTATYFCARDTNDGW

YINRLDLWGPGTLVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKD

TLMISRTPEVTCVVVDVSHEDPEVKFNWYVDGVEVHNAKTKPREEQYAST

YRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK.

In one embodiment, the invention includes antibodies and antibody fragments having binding specificity to PCSK9 that contain a variable heavy chain sequence comprising the sequence set forth below:

(SEQ ID NO: 802)
QSVEESGGRLVTPGTPLTLTCTVSGFSLSSYAMNWVRQAPGKGLEWIGAI

RSSGATFFASWVNGRFTISKTSTTVDLKITSPTPEDTATYFCARDTNDGW

YINRLDLWGPGTLVTVSS.

In another embodiment, the invention includes antibodies and antibody fragments having binding specificity to PCSK9 that possess the same epitopic specificity as Ab21 and which contain a constant heavy chain sequence comprising the sequence set forth below:

(SEQ ID NO: 810)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 821)
AAVLTQTPSPVSAAVGGTVSISCQSSKSVYSNYLSWFQQKPGQPPKFLIY

KASTLASGVPSRFKGSGSGTQFTLTISDVQCDDAATYYCAGGDTNISDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 822)
AAVLTQTPSPVSAAVGGTVSISCQSSKSVYSNYLSWFQQKPGQPPKFLIY

KASTLASGVPSRFKGSGSGTQFTLTISDVQCDDAATYYCAGGDTNISDNA

FGGGTEVVVK.

In another embodiment, the invention includes antibodies and antibody fragments having binding specificity to PCSK9 that bind the same epitope as Ab21 which contain a constant light chain sequence comprising the sequence set forth below:

(SEQ ID NO: 830)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 804; SEQ ID NO: 806; and SEQ ID NO: 808 which correspond to the complementarity-determining regions (CDRs, or hypervariable regions) of the heavy chain sequence of SEQ ID NO: 801 or which contain the variable heavy chain sequence of SEQ ID NO: 802, and/or which further contain one, two, or three of the polypeptide sequences of SEQ ID NO: 824; SEQ ID NO: 826; and SEQ ID NO: 828 which correspond to the complementarity-determining regions (CDRs, or hypervariable regions) of the light chain sequence of SEQ ID NO: 821 or which contain the variable light chain sequence of SEQ ID NO: 822, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 803; SEQ ID NO: 805; SEQ ID NO: 807; and SEQ ID NO: 809 which correspond to the framework regions (FRs or constant regions) of the heavy chain sequence of SEQ ID NO: 801 or the variable heavy chain sequence of SEQ ID NO: 802, and/or one, two, three, or four of the polypeptide sequences of SEQ ID NO: 823; SEQ ID NO: 825; SEQ ID NO: 827; and SEQ ID NO: 829 which correspond to the framework regions (FRs or constant regions) of the light chain sequence of SEQ ID NO: 821 or the variable light chain sequence of SEQ ID NO: 822, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 801 or SEQ ID NO: 802 or polypeptides that are at least 90% or 95% identical thereto. In another embodiment of the invention, antibody fragments of the invention comprise, or alternatively consist of, the polypeptide sequence of SEQ ID NO: 821 or SEQ ID NO: 822 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 804; SEQ ID NO: 806; and SEQ ID NO: 808 which correspond to the complementarity-determining regions (CDRs, or hypervariable regions) of the heavy chain sequence of SEQ ID NO: 801 or the variable heavy chain sequence of SEQ ID NO: 802 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 824; SEQ ID NO: 826; and SEQ ID NO: 828 which correspond to the complementarity-determining regions (CDRs, or hypervariable regions) of the light chain sequence of SEQ ID NO: 821 or the variable light chain sequence of SEQ ID NO: 822 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 803; SEQ ID NO: 805; SEQ ID NO: 807; and SEQ ID NO: 809 which correspond to the framework regions (FRs or constant regions) of the heavy chain sequence of SEQ ID NO: 801 or the variable heavy chain sequence of SEQ ID NO: 802 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 823; SEQ ID NO: 825; SEQ ID NO: 827; and SEQ ID NO: 829 which correspond to the framework regions (FRs or constant regions) of the light chain sequence of SEQ ID NO: 821 or the variable light chain sequence of SEQ ID NO: 822 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 802; the variable light chain region of SEQ ID NO: 822; the complementarity-determining regions (SEQ ID NO: 804; SEQ ID NO: 806; and SEQ ID NO: 808) of the variable heavy chain region of SEQ ID NO: 802; and the complementarity-determining regions (SEQ ID NO: 824; SEQ ID NO: 826; and SEQ ID NO: 828) of the variable light chain region of SEQ ID NO: 822 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 802; the variable light chain region of SEQ ID NO: 822; the framework regions (SEQ ID NO: 803; SEQ ID NO: 805; SEQ ID NO: 807; and SEQ ID NO: 809) of the variable heavy chain region of SEQ ID NO: 802; and the framework regions (SEQ ID NO: 823; SEQ ID NO: 825; SEQ ID NO: 827; and SEQ ID NO: 829) of the variable light chain region of SEQ ID NO: 822 or sequences that are at least 90% or 95% identical thereto.

In a particularly preferred embodiment of the invention, the anti-PCSK9 antibody is Ab21, comprising, or alternatively consisting of, SEQ ID NO: 801 and SEQ ID NO: 821, or an antibody or antibody fragment comprising the CDRs of Ab21 and having at least one of the biological activities set forth herein or is an anti-PCSK9 antibody that competes with Ab21 in binding PCSK9, preferably one containing sequences that are at least 90%, 95%, 96%, 97%, 98% or 99% identical to that of Ab21 or an antibody that binds to the same or overlapping epitope(s) on PCSK9 as Ab21.

In a further particularly preferred embodiment of the invention, antibody fragments comprise, or alternatively consist of, Fab (fragment antigen binding) fragments having binding specificity for PCSK9. With respect to antibody Ab21, the Fab fragment preferably includes the variable heavy chain sequence of SEQ ID NO: 802 and the variable light chain sequence of SEQ ID NO: 822 or sequences that are at least 90%, 95%, 96%, 97%, 98% or 99% identical thereto. This embodiment of the invention further includes Fabs containing additions, deletions, and variants of SEQ ID NO: 802 and/or SEQ ID NO: 822 which retain the binding specificity for PCSK9.

In one embodiment of the invention described herein (infra), Fab fragments may be produced by enzymatic digestion (e.g., papain) of Ab21. In another embodiment of the invention, anti-PCSK9 antibodies such as Ab21 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab21 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab22

In one embodiment, the invention includes antibodies and antibody fragments having binding specificity to PCSK9 that possess a heavy chain sequence comprising the sequence set forth below:

(SEQ ID NO: 841)
EVQLVESGGGLVQPGGSLRLSCAASGFSLSSYAMNWVRQAPGKGLEWIGA

IRSSGATFFASSVNGRFTISRDNSKNTVYLQMNSLRAEDTAVYYCARDTN

DGWYINRLDLWGQGTLVTVSSASTKGPSVFPLAPSSKSTSGGTAALGCLV

KDYFPEPVTVSWNSGALTSGVHTFPAVLQSSGLYSLSSVVTVPSSSLGTQ

TYICNVNHKPSNTKVDARVEPKSCDKTHTCPPCPAPELLGGPSVFLFPPK

PKDTLMISRTPEVTCVVVDVSHEDPEVKFNWYVDGVEVHNAKTKPREEQY

ASTYRVVSVLTVLHQDWLNGKEYKCKVSNKALPAPIEKTISKAKGQPREP

-continued
QVYTLPPSREEMTKNQVSLTCLVKGFYPSDIAVEWESNGQPENNYKTTPP

VLDSDGSFFLYSKLTVDKSRWQQGNVFSCSVMHEALHNHYTQKSLSLSPG

K.

In one embodiment, the invention includes antibodies and antibody fragments having binding specificity to PCSK9 that contain a variable heavy chain sequence comprising the sequence set forth below:

(SEQ ID NO: 842)
EVQLVESGGGLVQPGGSLRLSCAASGFSLSSYAMNWVRQAPGKGLEWIGA

IRSSGATFFASSVNGRFTISRDNSKNTVYLQMNSLRAEDTAVYYCARDTN

DGWYINRLDLWGQGTLVTVSS.

In another embodiment, the invention includes antibodies and antibody fragments having binding specificity to PCSK9 that possess the same epitopic specificity as Ab22 and which contain a constant heavy chain sequence comprising the sequence set forth below:

(SEQ ID NO: 850)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 861)
AVLTQSPSTLSASVGDRVTITCQSSKSVYSNYLSWFQQKPGKAPKFLIYK

ASTLASGVPSRFSGSGSGTEFTLTISSLQPDDFATYYCAGGDTNIADNAF

GGGTKVEIKRTVAAPSVFIFPPSDEQLKSGTASVVCLLNNFYPREAKVQW

KVDNALQSGNSQESVTEQDSKDSTYSLSSTLTLSKADYEKHKVYACEVTH

QGLSSPVTKSFNRGEC.

In another embodiment, the invention includes antibodies and antibody fragments having binding specificity to PCSK9 that contain a variable light chain sequence comprising the sequence set forth below:

(SEQ ID NO: 862)
AVLTQSPSTLSASVGDRVTITCQSSKSVYSNYLSWFQQKPGKAPKFLIYK

ASTLASGVPSRFSGSGSGTEFTLTISSLQPDDFATYYCAGGDTNIADNAF

GGGTKVEIK.

In another embodiment, the invention includes antibodies and antibody fragments having binding specificity to PCSK9 that bind the same epitope as Ab22 which contain a constant light chain sequence comprising the sequence set forth below:

(SEQ ID NO: 870)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In another embodiment, the invention includes antibodies and antibody fragments having binding specificity to PCSK9 that contain one, two, or three of the polypeptide sequences of SEQ ID NO: 844; SEQ ID NO: 846; and SEQ ID NO: 848 which correspond to the complementarity-determining regions (CDRs, or hypervariable regions) of the heavy chain sequence of SEQ ID NO: 841 or which contain the variable heavy chain sequence of SEQ ID NO: 842, and/or which further contain one, two, or three of the polypeptide sequences of SEQ ID NO: 864; SEQ ID NO: 866; and SEQ ID NO: 868 which correspond to the complementarity-determining regions (CDRs, or hypervariable regions) of the light chain sequence of SEQ ID NO: 861 or which contain the variable light chain sequence of SEQ ID NO: 862, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 843; SEQ ID NO: 845; SEQ ID NO: 847; and SEQ ID NO: 849 which correspond to the framework regions (FRs or constant regions) of the heavy chain sequence of SEQ ID NO: 841 or the variable heavy chain sequence of SEQ ID NO: 842, and/or one, two, three, or four of the polypeptide sequences of SEQ ID NO: 863; SEQ ID NO: 865; SEQ ID NO: 867; and SEQ ID NO: 869 which correspond to the framework regions (FRs or constant regions) of the light chain sequence of SEQ ID NO: 861 or the variable light chain sequence of SEQ ID NO: 862, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 841 or SEQ ID NO: 842 or polypeptides that are at least 90% or 95% identical thereto. In another embodiment of the invention, antibody fragments of the invention comprise, or alternatively consist of, the polypeptide sequence of SEQ ID NO: 861 or SEQ ID NO: 862 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 844; SEQ ID NO: 846; and SEQ ID NO: 848 which correspond to the complementarity-determining regions (CDRs, or hypervariable regions)

of the heavy chain sequence of SEQ ID NO: 841 or the variable heavy chain sequence of SEQ ID NO: 842 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 864; SEQ ID NO: 866; and SEQ ID NO: 868 which correspond to the complementarity-determining regions (CDRs, or hypervariable regions) of the light chain sequence of SEQ ID NO: 861 or the variable light chain sequence of SEQ ID NO: 862 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 843; SEQ ID NO: 845; SEQ ID NO: 847; and SEQ ID NO: 849 which correspond to the framework regions (FRs or constant regions) of the heavy chain sequence of SEQ ID NO: 841 or the variable heavy chain sequence of SEQ ID NO: 842 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 863; SEQ ID NO: 865; SEQ ID NO: 867; and SEQ ID NO: 869 which correspond to the framework regions (FRs or constant regions) of the light chain sequence of SEQ ID NO: 861 or the variable light chain sequence of SEQ ID NO: 862 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 842; the variable light chain region of SEQ ID NO: 862; the complementarity-determining regions (SEQ ID NO: 844; SEQ ID NO: 846; and SEQ ID NO: 848) of the variable heavy chain region of SEQ ID NO: 842; and the complementarity-determining regions (SEQ ID NO: 864; SEQ ID NO: 866; and SEQ ID NO: 868) of the variable light chain region of SEQ ID NO: 862 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 842; the variable light chain region of SEQ ID NO: 862; the framework regions (SEQ ID NO: 843; SEQ ID NO: 845; SEQ ID NO: 847; and SEQ ID NO: 849) of the variable heavy chain region of SEQ ID NO: 842; and the framework regions (SEQ ID NO: 863; SEQ ID NO: 865; SEQ ID NO: 867; and SEQ ID NO: 869) of the variable light chain region of SEQ ID NO: 862 or sequences that are at least 90% or 95% identical thereto.

In a particularly preferred embodiment of the invention, the anti-PCSK9 antibody is Ab22, comprising, or alternatively consisting of, SEQ ID NO: 841 and SEQ ID NO: 861, or an antibody or antibody fragment comprising the CDRs of Ab22 and having at least one of the biological activities set forth herein or is an anti-PCSK9 antibody that competes with Ab22 in binding PCSK9, preferably one containing sequences that are at least 90%, 95%, 96%, 97%, 98% or 99% identical to that of Ab22 or an antibody that binds to the same or overlapping epitope(s) on PCSK9 as Ab22.

In a further particularly preferred embodiment of the invention, antibody fragments comprise, or alternatively consist of, Fab (fragment antigen binding) fragments having binding specificity for PCSK9. With respect to antibody Ab22, the Fab fragment preferably includes the variable heavy chain sequence of SEQ ID NO: 842 and the variable light chain sequence of SEQ ID NO: 862 or sequences that are at least 90%, 95%, 96%, 97%, 98% or 99% identical thereto. This embodiment of the invention further includes Fabs containing additions, deletions, and variants of SEQ ID NO: 842 and/or SEQ ID NO: 862 which retain the binding specificity for PCSK9.

In one embodiment of the invention described herein (infra), Fab fragments may be produced by enzymatic digestion (e.g., papain) of Ab22. In another embodiment of the invention, anti-PCSK9 antibodies such as Ab22 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab22 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab23

In one embodiment, the invention includes antibodies and antibody fragments having binding specificity to PCSK9 that possess a heavy chain sequence comprising the sequence set forth below:

```
                                              (SEQ ID NO: 881)
QSLEESGGDLVKPGASLTLTCKASGFSFSSGYYMCWVRQAPGKGLEWIAC

IYAGSGGSTFFANWAKGRFTISKTSSTTVTLQMTSLTAADTATYFCARDG

GYAGYGYAFFNLWGPGTLVTVSSASTKGPSVFPLAPSSKSTSGGTAALGC

LVKDYFPEPVTVSWNSGALTSGVHTFPAVLQSSGLYSLSSVVTVPSSSLG

TQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREE

QYASTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTT

PPVLDSDGSFFLYSKLTVDKSRWQQGNVFSCSVMHEALHNHYTQKSLSLS

PGK.
```

In one embodiment, the invention includes antibodies and antibody fragments having binding specificity to PCSK9 that contain a variable heavy chain sequence comprising the sequence set forth below:

```
                                              (SEQ ID NO: 882)
QSLEESGGDLVKPGASLTLTCKASGFSFSSGYYMCWVRQAPGKGLEWIAC

IYAGSGGSTFFANWAKGRFTISKTSSTTVTLQMTSLTAADTATYFCARDG

GYAGYGYAFFNLWGPGTLVTVSS.
```

In another embodiment, the invention includes antibodies and antibody fragments having binding specificity to PCSK9 that possess the same epitopic specificity as Ab23 and which contain a constant heavy chain sequence comprising the sequence set forth below:

(SEQ ID NO: 890)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 901)
DVVMTQTPASVSEPVGGTVTIKCQASERIYSGLAWYQQKPGQPPKLLIYG

ASTLASGVPSRFKGSGSGTDFTLTISDLECDDAAIYYCQCTYYGSSYPNV

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 902)
DVVMTQTPASVSEPVGGTVTIKCQASERIYSGLAWYQQKPGQPPKLLIYG

ASTLASGVPSRFKGSGSGTDFTLTISDLECDDAAIYYCQCTYYGSSYPNV

FGGGTEVVVK.

In another embodiment, the invention includes antibodies and antibody fragments having binding specificity to PCSK9 that bind the same epitope as Ab23 which contain a constant light chain sequence comprising the sequence set forth below:

(SEQ ID NO: 910)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

In another embodiment, the invention includes antibodies and antibody fragments having binding specificity to PCSK9 that contain one, two, or three of the polypeptide sequences of SEQ ID NO: 884; SEQ ID NO: 886; and SEQ ID NO: 888 which correspond to the complementarity-determining regions (CDRs, or hypervariable regions) of the heavy chain sequence of SEQ ID NO: 881 or which contain the variable heavy chain sequence of SEQ ID NO: 882, and/or which further contain one, two, or three of the polypeptide sequences of SEQ ID NO: 904; SEQ ID NO: 906; and SEQ ID NO: 908 which correspond to the complementarity-determining regions (CDRs, or hypervariable regions) of the light chain sequence of SEQ ID NO: 901 or which contain the variable light chain sequence of SEQ ID NO: 902, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 883; SEQ ID NO: 885; SEQ ID NO: 887; and SEQ ID NO: 889 which correspond to the framework regions (FRs or constant regions) of the heavy chain sequence of SEQ ID NO: 881 or the variable heavy chain sequence of SEQ ID NO: 882, and/or one, two, three, or four of the polypeptide sequences of SEQ ID NO: 903; SEQ ID NO: 905; SEQ ID NO: 907; and SEQ ID NO: 909 which correspond to the framework regions (FRs or constant regions) of the light chain sequence of SEQ ID NO: 901 or the variable light chain sequence of SEQ ID NO: 902, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 881 or SEQ ID NO: 882 or polypeptides that are at least 90% or 95% identical thereto. In another embodiment of the invention, antibody fragments of the invention comprise, or alternatively consist of, the polypeptide sequence of SEQ ID NO: 901 or SEQ ID NO: 902 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 884; SEQ ID NO: 886; and SEQ ID NO: 888 which correspond to the complementarity-determining regions (CDRs, or hypervariable regions) of the heavy chain sequence of SEQ ID NO: 881 or the variable heavy chain sequence of SEQ ID NO: 882 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 904; SEQ ID NO: 906; and SEQ ID NO: 908 which correspond to the complementarity-determining regions (CDRs, or hypervariable regions) of the light chain sequence of SEQ ID NO: 901 or the variable light chain sequence of SEQ ID NO: 902 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 883; SEQ ID NO: 885; SEQ ID NO: 887; and SEQ ID NO: 889 which correspond to the framework regions (FRs or constant regions) of the heavy chain sequence of SEQ ID NO: 881 or the variable heavy chain sequence of SEQ ID NO: 882 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 903; SEQ ID NO: 905; SEQ ID NO: 907; and SEQ ID NO: 909 which correspond to the framework regions (FRs or constant regions) of the light chain sequence of SEQ ID NO: 901 or the variable light chain sequence of SEQ ID NO: 902 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 882; the variable light chain region of SEQ ID NO: 902; the complementarity-determining regions (SEQ ID NO: 884; SEQ ID NO: 886; and SEQ ID NO: 888) of the variable heavy chain region of SEQ ID NO: 882; and the complementarity-determining regions (SEQ ID NO: 904; SEQ ID NO: 906; and SEQ ID NO: 908) of the variable light chain region of SEQ ID NO: 902 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 882; the variable light chain region of SEQ ID NO: 902; the framework regions (SEQ ID NO: 883; SEQ ID NO: 885; SEQ ID NO: 887; and SEQ ID NO: 889) of the variable heavy chain region of SEQ ID NO: 882; and the framework regions (SEQ ID NO: 903; SEQ ID NO: 905; SEQ ID NO: 907; and SEQ ID NO: 909) of the variable light chain region of SEQ ID NO: 902 or sequences that are at least 90% or 95% identical thereto.

In a particularly preferred embodiment of the invention, the anti-PCSK9 antibody is Ab23, comprising, or alternatively consisting of, SEQ ID NO: 881 and SEQ ID NO: 901, or an antibody or antibody fragment comprising the CDRs of Ab23 and having at least one of the biological activities set forth herein or is an anti-PCSK9 antibody that competes with Ab23 in binding PCSK9, preferably one containing sequences that are at least 90%, 95%, 96%, 97%, 98% or 99% identical to that of Ab23 or an antibody that binds to the same or overlapping epitope(s) on PCSK9 as Ab23.

In a further particularly preferred embodiment of the invention, antibody fragments comprise, or alternatively consist of, Fab (fragment antigen binding) fragments having binding specificity for PCSK9. With respect to antibody Ab23, the Fab fragment preferably includes the variable heavy chain sequence of SEQ ID NO: 882 and the variable light chain sequence of SEQ ID NO: 902 or sequences that are at least 90%, 95%, 96%, 97%, 98% or 99% identical thereto. This embodiment of the invention further includes Fabs containing additions, deletions, and variants of SEQ ID NO: 882 and/or SEQ ID NO: 902 which retain the binding specificity for PCSK9.

In one embodiment of the invention described herein (infra), Fab fragments may be produced by enzymatic digestion (e.g., papain) of Ab23. In another embodiment of the invention, anti-PCSK9 antibodies such as Ab23 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab23 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab24

In one embodiment, the invention includes antibodies and antibody fragments having binding specificity to PCSK9 that possess a heavy chain sequence comprising the sequence set forth below:

(SEQ ID NO: 921)
QSLEESGGDLVKPGASLTLTCKASGFSFSSGYYMCWVRQAPGKGLEWIA

CIYAGSGGSTFFANWAKGRFTISKTSSTTVTLQMTSLTAADTATYFCAR

DGGYAGYGYAFFNLWGPGTLVTVSSASTKGPSVFPLAPSSKSTSGGTAA

LGCLVKDYFPEPVTVSWNSGALTSGVHTFPAVLQSSGLYSLSSVVTVPS

SSLGTQTYICNVNHKPSNTKVDKRVEPKSCDKTHTCPPCPAPELLGGPS

VFLFPPKPKDTLMISRTPEVTCVVVDVSHEDPEVKFNWYVDGVEVHNAK

TKPREEQYASTYRVVSVLTVLHQDWLNGKEYKCKVSNKALPAPIEKTIS

KAKGQPREPQVYTLPPSREEMTKNQVSLTCLVKGFYPSDIAVEWESNGQ

PENNYKTTPPVLDSDGSFFLYSKLTVDKSRWQQGNVFSCSVMHEALHNH

YTQKSLSLSPGK.

In one embodiment, the invention includes antibodies and antibody fragments having binding specificity to PCSK9 that contain a variable heavy chain sequence comprising the sequence set forth below:

(SEQ ID NO: 922)
QSLEESGGDLVKPGASLTLTCKASGFSFSSGYYMCWVRQAPGKGLEWIA

CIYAGSGGSTFFANWAKGRFTISKTSSTTVTLQMTSLTAADTATYFCAR

DGGYAGYGYAFFNLWGPGTLVTVSS.

In another embodiment, the invention includes antibodies and antibody fragments having binding specificity to PCSK9 that possess the same epitopic specificity as Ab24 and which contain a constant heavy chain sequence comprising the sequence set forth below:

(SEQ ID NO: 930)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

-continued
VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to PCSK9 that contain a light chain sequence comprising the sequence set forth below:

(SEQ ID NO: 941)
DVVMTQTPASVSEPVGGTVTIKCQASERIYSGLAWYQQKPGQPPKLLIY

GASTLASGVPSRFKGSGSGTDFTLTISDLECDDAAIYYCQATYYGSSYP

NVFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYA

CEVTHQGLSSPVTKSFNRGEC.

In another embodiment, the invention includes antibodies and antibody fragments having binding specificity to PCSK9 that contain a variable light chain sequence comprising the sequence set forth below:

(SEQ ID NO: 942)
DVVMTQTPASVSEPVGGTVTIKCQASERIYSGLAWYQQKPGQPPKLLIY

GASTLASGVPSRFKGSGSGTDFTLTISDLECDDAAIYYCQATYYGSSYP

NVFGGGTEVVVK.

In another embodiment, the invention includes antibodies and antibody fragments having binding specificity to PCSK9 that bind the same epitope as Ab24 which contain a constant light chain sequence comprising the sequence set forth below:

(SEQ ID NO: 950)
RTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPV

TKSFNRGEC.

In another embodiment, the invention includes antibodies and antibody fragments having binding specificity to PCSK9 that contain one, two, or three of the polypeptide sequences of SEQ ID NO: 924; SEQ ID NO: 926; and SEQ ID NO: 928 which correspond to the complementarity-determining regions (CDRs, or hypervariable regions) of the heavy chain sequence of SEQ ID NO: 921 or which contain the variable heavy chain sequence of SEQ ID NO: 922, and/or which further contain one, two, or three of the polypeptide sequences of SEQ ID NO: 944; SEQ ID NO: 946; and SEQ ID NO: 948 which correspond to the complementarity-determining regions (CDRs, or hypervariable regions) of the light chain sequence of SEQ ID NO: 941 or which contain the variable light chain sequence of SEQ ID NO: 942, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-PCSK9 antibodies and antibody fragments comprising one, two, three, or four of the polypeptide sequences of SEQ ID NO: 923; SEQ ID NO: 925; SEQ ID NO: 927; and SEQ ID NO: 929 which correspond to the framework regions (FRs or constant regions) of the heavy chain sequence of SEQ ID NO: 921 or the variable heavy chain sequence of SEQ ID NO: 922, and/or one, two, three, or four of the polypeptide sequences of SEQ ID NO: 943; SEQ ID NO: 945; SEQ ID NO: 947; and SEQ ID NO: 949 which correspond to the framework regions (FRs or constant regions) of the light chain sequence of SEQ ID NO: 941 or the variable light chain sequence of SEQ ID NO: 942, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-PCSK9 antibody fragments of the invention comprise, or alternatively consist of, the polypeptide sequence of SEQ ID NO: 921 or SEQ ID NO: 922 or polypeptides that are at least 90% or 95% identical thereto. In another embodiment of the invention, antibody fragments of the invention comprise, or alternatively consist of, the polypeptide sequence of SEQ ID NO: 941 or SEQ ID NO: 942 or polypeptides that are at least 90%, 95%, 96%, 97%, 98% or 99% identical thereto.

In a further embodiment of the invention, the antibody or antibody fragment having binding specificity to PCSK9 comprises, or alternatively consists of, one, two, or three of the polypeptide sequences of SEQ ID NO: 924; SEQ ID NO: 926; and SEQ ID NO: 928 which correspond to the complementarity-determining regions (CDRs, or hypervariable regions) of the heavy chain sequence of SEQ ID NO: 921 or the variable heavy chain sequence of SEQ ID NO: 922 or sequences that are at least 90% or 95% identical thereto.

In a further embodiment of the invention, the antibody or antibody fragment having binding specificity to PCSK9 comprises, or alternatively consists of, one, two, or three of the polypeptide sequences of SEQ ID NO: 944; SEQ ID NO: 946; and SEQ ID NO: 948 which correspond to the complementarity-determining regions (CDRs, or hypervariable regions) of the light chain sequence of SEQ ID NO: 941 or the variable light chain sequence of SEQ ID NO: 942 or sequences that are at least 90% or 95% identical thereto.

In a further embodiment of the invention, the antibody or antibody fragment having binding specificity to PCSK9 comprises, or alternatively consists of, one, two, three, or four of the polypeptide sequences of SEQ ID NO: 923; SEQ ID NO: 925; SEQ ID NO: 927; and SEQ ID NO: 929 which correspond to the framework regions (FRs or constant regions) of the heavy chain sequence of SEQ ID NO: 921 or the variable heavy chain sequence of SEQ ID NO: 922 or sequences that are at least 90% or 95% identical thereto.

In a further embodiment of the invention, the subject antibody or antibody fragment having binding specificity to PCSK9 comprises, or alternatively consists of, one, two, three, or four of the polypeptide sequences of SEQ ID NO: 943; SEQ ID NO: 945; SEQ ID NO: 947; and SEQ ID NO: 949 which correspond to the framework regions (FRs or constant regions) of the light chain sequence of SEQ ID NO: 941 or the variable light chain sequence of SEQ ID NO: 942 or sequences that are at least 90% or 95% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 922; the variable light chain region of SEQ ID NO: 942; the complementarity-determining regions (SEQ ID NO: 924; SEQ ID NO: 926; and SEQ ID NO: 928) of the variable heavy chain region of SEQ ID NO: 922; and the complementarity-determining regions (SEQ ID NO: 944; SEQ ID NO: 946; and SEQ ID NO: 948) of the variable light chain region of SEQ ID NO: 942 or sequences that are at least 90%, 95%, 96%, 97%, 98% or 99% identical thereto.

The invention also contemplates antibody fragments that include one or more of the antibody fragments described herein. In one embodiment of the invention, fragments of the antibodies having binding specificity to PCSK9 comprise, or alternatively consist of, one, two, three or more, including all of the following antibody fragments: the variable heavy chain region of SEQ ID NO: 922; the variable light chain region of SEQ ID NO: 942; the framework regions (SEQ ID NO: 923; SEQ ID NO: 925; SEQ ID NO: 927; and SEQ ID NO: 929) of the variable heavy chain region of SEQ ID NO: 922; and the framework regions (SEQ ID NO: 943; SEQ ID NO: 945; SEQ ID NO: 947; and SEQ ID NO: 949) of the variable light chain region of SEQ ID NO: 942 or sequences that are at least 90% or 95% identical thereto.

In a particularly preferred embodiment of the invention, the anti-PCSK9 antibody is Ab24, comprising, or alternatively consisting of, SEQ ID NO: 921 and SEQ ID NO: 941, or an antibody or antibody fragment comprising the CDRs of Ab24 and having at least one of the biological activities set forth herein or is an anti-PCSK9 antibody that competes with Ab24 in binding PCSK9, preferably one containing sequences that are at least 90%, 95%, 96%, 97%, 98% or 99% identical to that of Ab24 or an antibody that binds to the same or overlapping epitope(s) on PCSK9 as Ab24.

In a further particularly preferred embodiment of the invention, antibody fragments comprise, or alternatively consist of, Fab (fragment antigen binding) fragments having binding specificity for PCSK9. With respect to antibody Ab24, the Fab fragment preferably includes the variable heavy chain sequence of SEQ ID NO: 922 and the variable light chain sequence of SEQ ID NO: 942 or sequences that are at least 90%, 95%, 96%, 97%, 98% or 99% identical thereto. This embodiment of the invention further includes Fabs containing additions, deletions, and variants of SEQ ID NO: 922 and/or SEQ ID NO: 942 which retain the binding specificity for PCSK9.

In one embodiment of the invention described herein (infra), Fab fragments may be produced by enzymatic digestion (e.g., papain) of Ab24. In another embodiment of the invention, anti-PCSK9 antibodies such as Ab24 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to PCSK9, including the heavy and/or light chains of Ab24 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

In another embodiment, the invention contemplates an isolated anti-PCSK9 antibody comprising a $V_H$ polypeptide sequence selected from: SEQ ID NO: 2, SEQ ID NO: 42, SEQ ID NO: 82, SEQ ID NO: 122, SEQ ID NO: 162, SEQ ID NO: 202, SEQ ID NO: 242, SEQ ID NO: 282, SEQ ID NO: 322, SEQ ID NO: 362, SEQ ID NO: 402, SEQ ID NO: 442, SEQ ID NO: 482, SEQ ID NO: 522, SEQ ID NO: 562, SEQ ID NO: 602, SEQ ID NO: 642, SEQ ID NO: 692, SEQ ID NO: 732, SEQ ID NO: 772, SEQ ID NO: 812, SEQ ID NO: 852, SEQ ID NO: 892, SEQ ID NO: 932, or a variant thereof; and further comprising a $V_L$ polypeptide sequence selected from: SEQ ID NO: 22, SEQ ID NO: 62, SEQ ID NO: 102, SEQ ID NO: 142, SEQ ID NO: 182, SEQ ID NO: 222, SEQ ID NO: 262, SEQ ID NO: 302, SEQ ID NO: 342, SEQ ID NO: 382, SEQ ID NO: 422, SEQ ID NO: 462, SEQ ID NO: 502, SEQ ID NO: 542, SEQ ID NO: 582, SEQ ID NO: 622, SEQ ID NO: 662, SEQ ID NO: 702, SEQ ID NO: 742, SEQ ID NO: 782, SEQ ID NO: 822, SEQ ID NO: 862, SEQ ID NO: 902, SEQ ID NO: 942, or a variant thereof, wherein one or more of the framework residues (FR residues) and/or CDR residues in said $V_H$ or $V_L$ polypeptide has been substituted with another amino acid residue resulting in an anti-PCSK9 antibody that specifically binds PCSK9. The invention also includes humanized and chimeric forms of these antibodies. The chimeric and humanized antibodies may include an Fc derived from IgG1, IgG2, IgG3, IgG4, IgG5, IgG6, IgG7, IgG8, IgG9, IgG10, IgG11, IgG12, IgG13, IgG14, IgG15, IgG16, IgG17, IgG18 or IgG19 constant regions.

In one embodiment of the invention, the chimeric or humanized antibodies or fragments or $V_H$ or $V_L$ polypeptides originate or are derived from one or more rabbit antibodies, e.g., a rabbit antibody isolated from clonal rabbit B cell population.

In some aspects, the invention comprises a vector comprising a nucleic acid molecule encoding an anti-PCSK9 antibody or fragment thereof according to the invention. In some embodiments, the invention comprises a host cell comprising a nucleic acid molecule encoding an anti-PCSK9 antibody or fragment thereof according to the invention.

In some aspects, the invention comprises an isolated antibody or antibody fragment according to the invention that competes for binding to PCSK9 with an antibody or antibody fragment according to the invention disclosed herein.

In some aspects, the invention comprises a nucleic acid molecule encoding an antibody or antibody fragment according to the invention.

In some aspects, the invention comprises a pharmaceutical or diagnostic composition comprising at least one antibody or antibody fragment according to the invention.

In some aspects, the invention comprises a method for treating or preventing a condition associated with elevated serum cholesterol levels in a patient, comprising administering to a patient in need thereof an effective amount of at least one isolated antibody or antibody fragment according to the invention.

In some aspects, the invention comprises a method of inhibiting binding of PCSK9 to LDLR in a subject comprising administering an effective amount of at least one antibody or antibody fragment according to the invention.

In some aspects, the invention comprises an antibody or antibody fragment according to the invention that selectively binds to PCSK9, wherein the antibody or antibody fragment according to the invention binds to PCSK9 with a $K_D$ that is less than 100 µM.

In some aspects, the invention comprises a method for treating or preventing a condition associated with elevated serum cholesterol levels in a subject, the method comprising administering to a subject in need thereof an effective amount of at least one antibody or antibody fragment according to the invention simultaneously or sequentially with another active agent, e.g., an agent that elevates the availability of LDLR protein or which decreases serum cholesterol.

In some aspects, the invention comprises a method of lowering serum cholesterol level in a subject, the method comprising administering to a subject an effective amount of at least one antibody or antibody fragment according to the invention as disclosed herein.

In some aspects, the invention relates to the use of the antibodies described herein, or antibodies competing therewith or possessing the same or overlapping epitopic specificity, preferably antibodies or antibody fragments comprising one or all of the CDRs of one of the exemplified anti-PCSK9 antibodies or antibody fragments, or more preferably an antibody comprising one or more variable or CDR sequences which possess at least 80, 90, or 95% identity to any of the VH, VL and CDR polypeptides described herein, and to polynucleotides encoding these antibodies and antibody fragments and host cells containing. A preferred embodiment of the invention is directed to chimeric or humanized antibodies and fragments thereof (such as Fab or Fv or monovalent fragments) capable of binding to PCSK9, and preferably which inhibit, block or neutralize the biological activities of PCSK9 or which block or inhibit the binding of PCSK9 to LDLR.

In some aspects, the invention comprises an isolated antibody or antibody fragment that competes for binding to PCSK9 or binds with the same or an overlapping epitope on PCSK9 as an antibody or antibody fragment according to the invention.

In some aspects, the invention comprises a method for treating or preventing a condition associated with elevated serum cholesterol levels in a patient, comprising administering to a patient in need thereof an effective amount of at least one anti-PCSK9 antibody or antibody fragment according to the invention.

In some aspects, the invention comprises a method of inhibiting binding of PCSK9 to LDLR in a subject in need thereof comprising administering an effective amount of at least one anti-PCSK9 antibody or antibody fragment according to the invention.

In some aspects, the invention comprises an anti-PCSK9 antibody or antibody fragment according to the invention that binds to PCSK9 with a KD that is less than 100 nM.

In some aspects, the invention comprises a method for treating or preventing a condition associated with elevated serum cholesterol levels in a subject, the method comprising administering to a subject in need thereof an effective amount of at least one anti-PCSK9 antibody or antibody fragment according to the invention simultaneously or sequentially with another active agent, e.g., one that reduces cholesterol levels or which elevates the availability of LDLR protein.

In some aspects, the invention comprises a method of lowering serum cholesterol levels in a subject, the method comprising administering to a subject an effective amount of at least at least one anti-PCSK9 antibody or antibody fragment according to the invention.

In some aspects, the invention comprises a method of lowering serum cholesterol level in a subject, the method comprising administering to a subject an effective amount of at least one anti-PCSK9 antibody or antibody fragment according to the invention, simultaneously or sequentially with another agent that elevates the availability of LDLR protein.

In some aspects, the invention comprises a method of increasing LDLR protein level in a subject, the method comprising administering to a subject an effective amount of at least one anti-PCSK9 antibody or antibody fragment according to the invention.

In some aspects, the invention comprises a method of increasing LDLR protein levels in a subject, the method comprising administering to a subject an effective amount of at least one at least one anti-PCSK9 antibody or antibody fragment according to the invention simultaneously or sequentially with an agent that elevates the availability of LDLR protein.

In some aspects, the invention further provides methods of preventing or treating diseases and disorders associated with PCSK9, e.g., diseases associated with increased or decreased levels of PCSK9 and/or mutations in the PCSK9 gene that affect PCSK9 protein expression, primary sequence and/or function by administering at least one at least one anti-PCSK9 antibody or antibody fragment according to the invention in combination with other agents.

In other aspects the present invention provides methods for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma and related conditions using the subject anti-PCSK9 antibodies and antibody fragments.

In other specific aspects the present invention provides methods for treating or preventing disorders of cholesterol or lipid homeostasis and disorders and complications associated therewith, e.g., hypercholesterolemia, hyperlipidemia, hypertriglyceridaemia, sitosterolemia, atherosclerosis, arteriosclerosis, coronary heart disease, metabolic syndrome, acute coronary syndrome, vascular inflammation, xanthoma and other conditions such as obesity, hypertension, diabetes, wherein the subject is treated with the subject anti-PCSK9 antibodies and antibody fragments, in combination with other drugs used to treat such disorders such as e.g., statins, ACE inhibitors, Angiotensin II receptor blockers (ARBs), Antiarrhythmics, Antiplatelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, and other drugs used to treat conditions wherein the treated individual may have high cholesterol.

ACE inhibitors may be used in combination with the subject anti-PCSK9 antibodies and antibody fragments wherein the moities may be jointly or separately administered by the same or different means of administration include by way of example: Capoten (captopril), Vasotec (enalapril), Prinivil, Zestril (lisinopril), Lotensin (benazepril), Monopril (fosinopril), Altace (ramipril), Accupril (quinapril), Aceon (perindopril), Mavik (trandolapril), Univasc (moexipril), ARBs may be used in combination with the subject anti-PCSK9 antibodies and antibody fragments wherein the moities may be jointly or separately administered by the same or different means of administration include by way of example: Cozaar (losartan), Diovan (valsartan), Avapro (irbesartan), Atacand (candesartan), and Micardis (telmisartan).

Antiarrhythmics may be used in combination with the subject anti-PCSK9 antibodies and antibody fragments include by way of example: Tambocor (flecamide), Procanbid (procainamide), Cordarone (amiodarone), and Betapace (sotalol).

Antiplatelet Drugs which may be used in combination with the subject anti-PCSK9 antibodies and antibody fragments wherein the moities may be jointly or separately administered by the same or different means of administration include by way of example:

Anticlotting agents which may be used in combination with the subject anti-PCSK9 antibodies and antibody fragments wherein the moities may be jointly or separately administered by the same or different means of administration include: Tissue plasminogen activator (TPA), Tenecteplase, Alteplase, Urokinase, Reteplase, and Streptokinase.

Beta-blockers may be used in combination with the subject anti-PCSK9 antibodies and antibody fragments wherein the moities may be jointly or separately administered by the same or different means of administration include by way of example: Sectral (acebutolol), Zebeta (bisoprolol), Brevibloc (esmolol), Inderal (propranolol), Tenormin (atenolol), Normodyne, Trandate (labetalol), Coreg (carvedilol), Lopressor, and Toprol-XL (metoprolol).

Calcium channel blockers which may be used in combination with the subject anti-PCSK9 antibodies and antibody fragments wherein the moities may be jointly or separately administered by the same or different means of administration include by way of example: Norvasc (amlodipine), Plendil (felodipine), Cardizem, Cardizem CD, Cardizem SR, Dilacor XR, Diltia XT, Tiazac (diltiazem), Calan, Calan SR, Covera-HS, Isoptin, Isoptin SR, Verelan, Verelan PM (verapamil), Adalat, Adalat CC, Procardia, Procardia XL (nifedipine), Cardene, Cardene SR (nicardipine), Sular (nisoldipine), Vascor (bepridil), and Caduet which is a combination of a statin cholesterol drug and amlodipine.

Diuretics which may be used in combination with the subject anti-PCSK9 antibodies and antibody fragments wherein the moities may be jointly or separately administered by the same or different means of administration include: by way of example Lasix (furosemide), Bumex (bumetanide), Demadex (torsemide), Esidrix (hydrochlorothiazide), Zaroxolyn (metolazone), and Aldactone (spironolactone).

Heart failure drugs which may be used in combination with the subject anti-PCSK9 antibodies and antibody fragments wherein the moities may be jointly or separately administered by the same or different means of administration include by way of example Dobutrex (dobutamine), and Primacor (milrinone).

Vasodilators which may be used in combination with the subject anti-PCSK9 antibodies and antibody fragments wherein the moities may be jointly or separately administered by the same or different means of administration include by way of example Dilatrate-SR, Iso-Bid, Isonate, Isorbid, Isordil, Isotrate, Sorbitrate (isosorbide dinitrate), IMDUR (isorbide mononitrate), and BiDil (hydralazine with isosorbide dinitrate.

Blood thinners which may be used in combination with the subject anti-PCSK9 antibodies and antibody fragments wherein the moities may be jointly or separately administered by the same or different means of administration include by way of example Warfarin (coumadin), Heparin, Lovenox, and Fragmin.

In other aspects the present invention further provides methods for improving blood cholesterol markers associated with increased risk of heart disease using the subject antibodies and antibody fragments in association with any of the foregoing or other actives wherein the moities may be jointly or separately administered by the same or different means of administration. These markers include, but are not limited to, high total cholesterol, high LDL, high total cholesterol to HDL ratio and high LDL-C to HDL ratio.

In some aspects, the invention comprises a pharmaceutical composition comprising an antibody protein or fragment according to the invention and another active, e.g., one of the actives above-identified, e.g., an agent that elevates the availability of LDLR protein levels or an agent which blocks or inhibits cholesterol synthesis. In some embodiments, the agent that blocks or blocks cholesterol synthesis comprises a statin. The statin in some instances potentially may further elevate LDLR levels. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is further combined with niacin, an absorption inhibitor (ezetimibe), a lipid modifying agent, or a combination thereof. In some embodiments, the agent that elevates the availability of LDLR protein levels comprises a cytokine such as oncostatin M, or a hormone like estrogen, and/or a herbal moiety such as berberine.

In some aspects, the invention comprises a pharmaceutical composition comprising an antibody protein or fragment or variant thereof according to the invention and an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a pharmaceutical composition comprising an antibody protein or fragment according to the invention and a bile acid sequestering agent. In some embodiments, the bile sequestering agent is selected from the group consisting of cholestyramine, colesevelam, colestipol, and some combination thereof.

In some aspects, the invention comprises a pharmaceutical composition comprising an antibody or antibody fragment according to the invention and an agent that decreases cholesterol absorption in the intestine. In some embodiments, the agent that decreases cholesterol absorption in the intestine is ezetimibe.

In some aspects, the invention comprises a pharmaceutical composition comprising an antibody or fragment according to the invention and an agent that decreases cholesterol levels. In some embodiments, the agent that decreases cholesterol levels is selected from the group consisting of certain antipsychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a pharmaceutical composition comprising an antibody or fragment according to the invention and a PPAR gamma agonist, PPAR alpha/gamma agonist, squalene synthase inhibitor, CETP inhibitor, anti-hypertensive, anti-diabetic agent (such as sulphonyl ureas, insulin, GLP-1 analogs, DDPIV inhibitors), ApoB modulator, MTP inhibitors, arteriosclerosis obliterans treatments, or a combination thereof.

In some aspects, the invention comprises a pharmaceutical composition comprising an antibody or fragment according to the invention and an agent that increases HDL levels. In some embodiments, the agent that increases HDL levels is niacin, also known as nicotinic acid. In some embodiments, the niacin is a slow-release formulation.

In some aspects, the invention comprises a pharmaceutical composition comprising an antibody or fragment according to the invention and an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a pharmaceutical composition comprising an antibody or fragment according to the invention and an agent that decreases lipid absorption in the intestine. In some embodiments, the agent that decreases lipid absorption in the intestine is selected from the group consisting of orlistat, lipstatin, and some combination thereof.

In some aspects, the invention comprises a pharmaceutical composition comprising an antibody or fragment according to the invention and an agent that is an anti-hypertensive and/or treats angina. In some embodiments, the agent that is an anti-hypertensive and/or treats angina is amlodipine.

In some aspects, the invention comprises a pharmaceutical composition comprising an antibody or fragment according to the invention and at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention or fragment or variant thereof and at least one other agent are not administered simultaneously, with the antibody or antibody fragment according to the invention being administered before or after the at least one other agent is administered.

In some aspects, the invention comprises a pharmaceutical composition comprising an antibody or fragment according to the invention and at least one other agent for treating a condition associated with aberrant cholesterol or for treating a condition wherein the individuals often have high cholesterol. For example an antibody protein or fragment or variant thereof according to the invention may be combined or co-administered with other drugs such as ACE inhibitors, Angiotensin II receptor blockers (ARBs), Antiarrhythmics, Anti-platelet Drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetigenic drugs such as Alpha-glucosidase inhibitors, Biguanides, Dipeptidyl peptidase-4 inhibitors, Insulin therapies, Meglitinides, Sulfonylurea, and Thiazolidinediones, or other drugs used to treat conditions wherein the treated individual may have high cholesterol. Examples of such drugs are identified supra. In some embodiments, the antibody or fragment according to the invention and at least one other agent are not administered simultaneously, with the antibody or antibody fragment according to the invention being administered before or after the at least one other agent is administered.

In some aspects, the invention comprises a method for treating or preventing a condition associated with elevated serum cholesterol level in a patient comprising administering to a patient in need thereof an effective amount of at least one isolated antibody or antibody fragment according to the invention as disclosed herein. In some embodiments, the condition is hypercholesterolemia.

In some aspects, anti-PCSK9 antibodies or fragments according to the invention bind to PCSK9 with a KD that is less than about 100 nM. In some embodiments, the anti-PCSK9 antibodies or fragments according to the invention bind PCSK9 with a KD that is between about 10 and about 100 nM. In some embodiments, the anti-PCSK9 antibodies or fragments according to the invention bind PCSK9 with a KD that is less than about 10 nM. In some embodiments, the antibody or fragment that binds PCSK9 has a KD that is between about 1 and about 10 nM. In some embodiments, the anti-PCSK9 antibodies or fragments according to the invention that binds PCSK9 has a KD that is less than about 1 nM. In some embodiments, the anti-PCSK9 antibodies or fragments according to the invention has a KD that is between about 0.1 and about 1 nM. In some embodiments, the anti-PCSK9 antibodies or fragments according to the invention that binds PCSK9 has a KD that is between about 0.1 and about 0.5 nM. In some embodiments, the anti-PCSK9 antibodies or fragments according to the invention binds PCSK9 with a KD that is between about 0.01 and about 0.1 nM. In some embodiments, the anti-PCSK9 antibodies or fragments according to the invention binds PCSK9 with a KD that is between about 0.1 and about 10 nM. In some embodiments, the anti-PCSK9 antibodies or fragments according to the invention bind PCSK9 with a KD that is between 0.120 and about 7.99 nM.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases cholesterol and which optionally further elevates the availability of LDLR protein. In some embodiments, the agent that reduces cholesterol and which optionally elevates the availability of LDLR protein comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with a bile sequestering agent. In some embodiments, the bile sequestering agent is selected from the group consisting of cholestyramine, colesevelam, colestipol, and some combination thereof.

In some aspects, the invention comprises a method for treating or preventing a condition associated with elevated serum cholesterol levels in a subject, said method comprising administering to a subject in need thereof an effective amount of at least one isolated anti-PCSK9 antibodies or fragments according to the invention simultaneously or sequentially with an agent that decreases cholesterol absorption in the intestine. In some embodiments, the agent that decreases cholesterol absorption in the intestine is ezetimibe.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method for treating or preventing a condition associated with elevated serum cholesterol levels in a subject, said method comprising administering to a subject in need thereof an effective amount of at least one anti-PCSK9 antibody or fragment according to the invention simultaneously or sequentially with at least one other agent, wherein the combination allows for mitigation of undesirable side-effects of at least one other agent. In some embodiments, the anti-PCSK9 antibodies or fragments according to the invention and the at least one other agent are administered concurrently. In some embodiments, the antibody or antibody fragment according to the invention and at least one other agent are not administered simultaneously, with the anti-PCSK9 antibodies or fragments according to the invention being administered before or after the at least one other agent is administered.

In some aspects, the invention comprises a method of lowering the serum cholesterol level in a subject. The method comprises administering to a subject an effective amount of at least one anti-PCSK9 antibody or fragment according to the invention.

In some aspects, the invention comprises a method of lowering serum cholesterol levels in a subject comprising administering to a subject an effective amount of at least one anti-PCSK9 antibody or fragment according to the invention, simultaneously or sequentially with an agent that reduces cholesterol and which optionally further optionally elevates the availability of LDLR protein. In some embodiments, the agent that reduces cholesterol and further optionally elevates the availability of LDLR protein comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of lowering serum cholesterol levels in a subject comprising administering to a subject an effective amount of at least one anti-PCSK9 antibody or fragment according to the invention, simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of lowering serum cholesterol levels in a subject comprising administering to a subject an effective amount of at least one anti-PCSK9 antibody or fragment according to the invention, simultaneously or sequentially with a bile acid sequestering agent. In some embodiments, the bile sequestering agent is selected from the group consisting of cholestyramine, colesevelam, colestipol, and some combination thereof.

In some aspects, the invention comprises a method of lowering serum cholesterol levels in a subject comprising administering to a subject an effective amount of at least one at least one anti-PCSK9 antibody or fragment according to the invention, simultaneously or sequentially with an agent that decreases cholesterol absorption in the intestine. In some embodiments, the agent that decreases cholesterol absorption in the intestine is ezetimibe.

In some aspects, the invention comprises a method of lowering serum cholesterol levels in a subject comprising administering to a subject an effective amount of at least anti-PCSK9 antibody or fragment according to the invention, simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of lowering serum cholesterol levels in a subject comprising administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of lowering serum cholesterol levels in a subject comprising administering to a subject an effective amount of at least one anti-PCSK9 antibody or fragment according to the invention, simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of lowering serum cholesterol levels in a subject comprising administering to a subject an effective amount of at least one anti-PCSK9 antibody or fragment according to the invention, simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method of lowering serum cholesterol levels in a subject comprising administering to a subject an effective amount of at least one anti-PCSK9 antibody or fragment according to the invention, simultaneously or sequentially with an agent that is an anti-hypertensive and/or treats angina. In some embodiments, the agent that is an anti-hypertensive and/or treats angina is amlodipine.

In some aspects, the invention comprises a method of lowering serum cholesterol levels in a subject comprising administering to a subject an effective amount of at least one anti-PCSK9 antibody or fragment according to the invention, simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the anti-PCSK9 antibody or fragment according to the invention and at least one other agent are not administered simultaneously, with the antibody or antibody fragment according to the invention being administered before or after the at least one other agent is administered.

In some aspects, the invention comprises a method of increasing LDLR protein levels in a subject by administering to a subject an effective amount of at least one anti-PCSK9 antibody or fragment according to the invention as provided herein.

In some aspects, the invention comprises a method of increasing LDLR protein levels in a subject by administering to a subject an effective amount of at least one antibody or antibody fragment according to the invention simultaneously or sequentially with an agent that elevates the availability of LDLR protein or which reduces cholesterol. In some embodiments, the agent that reduces cholesterol comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of increasing LDLR protein levels in a subject by administering to a subject an effective amount of at least one antibody or antibody fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of increasing LDLR protein levels in a subject by administering to a subject an effective amount of at least one antibody or antibody fragment according to the invention simultaneously or sequentially with a bile acid sequestering agent. In some embodiments, the bile sequestering agent is selected from the group consisting of cholestyramine, colesevelam, colestipol, and some combination thereof.

In some aspects, the invention comprises a method of increasing LDLR protein levels in a subject by administering to a subject an effective amount of at least one antibody or antibody fragment according to the invention simultaneously or sequentially with an agent that decreases cholesterol absorption in the intestine. In some embodiments, the agent that decreases cholesterol absorption in the intestine is ezetimibe.

In some aspects, the invention comprises a method of increasing LDLR protein levels in a subject by administering to a subject an effective amount of at least one antibody or antibody fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of increasing LDLR protein levels in a subject by administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of increasing LDLR protein levels in a subject by administering to a subject an effective amount of at least one antibody or antibody fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of increasing LDLR protein levels in a subject by administering to a subject an effective amount of at least one antibody or antibody fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method of increasing LDLR protein levels in a subject by administering to a subject an effective amount of at least one antibody or antibody fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method of increasing LDLR protein levels in a subject by administering to a subject an effective amount of at least one antibody or antibody fragment according to the invention simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspects, the invention comprises a method of lowering serum cholesterol level in a subject, the method comprising administering to a subject an effective amount of at least one isolated antibody or antibody fragment according to the invention as disclosed herein, simultaneously or sequentially with another agent that elevates the availability of LDLR protein or which decreases serum cholesterol.

In some aspects, the invention comprises a method of increasing LDLR protein level in a subject, the method comprising administering to a subject an effective amount of at least one isolated antibody or antibody fragment according to the invention as disclosed herein.

In some aspects, the invention comprises a method of increasing LDLR protein levels in a subject, the method comprising administering to a subject an effective amount of at least one isolated antibody or antibody fragment according to the invention as disclosed herein simultaneously or sequentially with an agent that elevates the availability of LDLR protein.

In some aspects, the invention comprises a pharmaceutical or diagnostic composition comprising an antibody or antibody fragment according to the invention as disclosed herein and an agent that blocks or inhibits cholesterol synthesis or which elevates the availability LDLR. In some embodiments, the agent that blocks or inhibits cholesterol synthesis comprises a statin and may also increase the availability of LDLR. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a pharmaceutical or diagnostic composition comprising an antibody or antibody fragment according to the invention as disclosed herein and an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a pharmaceutical or diagnostic composition comprising an antibody or antibody fragment according to the invention as disclosed herein and a bile acid sequestering agent. In some embodiments, the bile sequestering agent is selected from the group consisting of cholestyramine, colesevelam, colestipol, and some combination thereof.

In some aspects, the invention comprises a pharmaceutical or diagnostic composition comprising an antibody or antibody fragment according to the invention as disclosed herein and an agent that decreases cholesterol absorption in the intestine. In some embodiments, the agent that decreases cholesterol absorption in the intestine is ezetimibe.

In some aspects, the invention comprises a pharmaceutical or diagnostic composition comprising an antibody or antibody fragment according to the invention as disclosed herein and an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a pharmaceutical or diagnostic composition comprising an antibody or antibody fragment according to the invention as disclosed herein and an agent that increases HDL levels. In some embodiments, the agent that increases HDL levels is niacin, also known as nicotinic acid. In some embodiments, the niacin is a slow-release formulation.

In some aspects, the invention comprises a pharmaceutical or diagnostic composition comprising an antibody or antibody fragment according to the invention as disclosed herein and an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a pharmaceutical or diagnostic composition comprising an antibody or antibody fragment according to the invention as disclosed herein and an agent that decreases lipid absorption in the intestine. In some embodiments, the agent that decreases lipid absorption in the intestine is selected from the group consisting of orlistat, lipstatin, and some combination thereof.

In some aspects, the invention comprises a pharmaceutical or diagnostic composition comprising an antibody or antibody fragment according to the invention as disclosed herein and an agent that is an anti-hypertensive and/or treats angina. In some embodiments, the agent that is an anti-hypertensive and/or treats angina is amlodipine.

In some aspects, the invention comprises a pharmaceutical or diagnostic composition comprising an antibody or antibody fragment according to the invention as disclosed herein and at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspect, the invention comprises a method of making the antibody or antibody fragment according to the invention as described herein, comprising the step of preparing said antibody or antibody fragment according to the invention from a host cell that secretes said antibody or antibody fragment according to the invention.

In some aspect, the invention comprises a pharmaceutical or diagnostic composition comprising at least one antibody or antibody fragment according to the invention as described herein and a pharmaceutically acceptable excipient. In some embodiments, the pharmaceutical or diagnostic composition further comprises an additional active agent. In some embodiments, said additional active agent is selected from the group consisting of a radioisotope, radionuclide, a toxin, or a therapeutic and a chemotherapeutic group.

In some aspects, the invention comprises a method for treating or preventing a condition associated with an elevated serum cholesterol level in a patient. The method comprises administering to a patient in need thereof an effective amount of at least one isolated antibody or antibody fragment according to the invention as disclosed herein. In some embodiments, the condition is hypercholesterolemia.

In some aspects, the invention comprises a method of inhibiting binding of PCSK9 to LDLR in a patient comprising administering an effective amount of at least one antibody or antibody fragment according to the invention according as described herein.

In some aspect, the invention comprises an antibody or antibody fragment according to the invention that binds to PCSK9 with a KD that is less than 100 nM. In some embodiments, the antibody or antibody fragment according to the invention binds with a KD that is less than 10 nM. In some embodiments, the antibody or antibody fragment according to the invention binds with a KD that is less than 5 nM.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that elevates the availability of LDLR protein or which blocks or inhibits cholesterol synthesis. In some embodiments, the agent that blocks or inhibits cholesterol synthesis comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with a bile acid sequestering agent. In some embodiments, the bile sequestering agent is selected from the group consisting of cholestyramine, colesevelam, colestipol, and some combination thereof.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that decreases cholesterol absorption in the intestine. In some embodiments, the agent that decreases cholesterol absorption in the intestine is ezetimibe.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that decreases cholesterol levels. In some embodiments, the agent that decreases cholesterol levels is selected from the group consisting of certain antipsychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with an agent that is an anti-hypertensive and/or treats angina. In some embodiments, the agent that is an anti-hypertensive and/or treats angina is amlodipine.

In some aspects, the invention comprises a method for treating or preventing a condition associated with elevated serum cholesterol levels in a subject, said method comprising administering to a subject in need thereof an effective amount of at least one isolated antibody or antibody fragment according to the invention described herein simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspects, the invention comprises a method of lowering the serum cholesterol level in a subject. The method comprises administering to a subject an effective amount of at least one isolated antibody or antibody fragment according to the invention as described herein.

In some aspects, the invention comprises a method of lowering serum cholesterol levels in a subject comprising administering to a subject an effective amount of at least one antibody or antibody fragment according to the invention simultaneously or sequentially with an agent that elevates the availability of LDLR protein or which blocks or inhibits cholesterol synthesis. In some embodiments, the agent that blocks or inhibits cholesterol synthesis comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of lowering serum cholesterol levels in a subject comprising administering to a subject an effective amount of at least one antibody or antibody fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of lowering serum cholesterol levels in a subject comprising administering to a subject an effective amount of at least one antibody or antibody fragment according to the invention simultaneously or sequentially with a bile acid sequestering agent. In some embodiments, the bile sequestering agent is selected from the group consisting of cholestyramine, colesevelam, colestipol, and some combination thereof.

In some aspects, the invention comprises a method of lowering serum cholesterol levels in a subject comprising administering to a subject an effective amount of at least one antibody or antibody fragment according to the invention simultaneously or sequentially with an agent that decreases cholesterol absorption in the intestine. In some embodiments, the agent that decreases cholesterol absorption in the intestine is ezetimibe.

In some aspects, the invention comprises a method of lowering serum cholesterol levels in a subject comprising administering to a subject an effective amount of at least one antibody or antibody fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of lowering serum cholesterol levels in a subject comprising administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of lowering serum cholesterol levels in a subject comprising administering to a subject an effective amount of at least one antibody or antibody fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of lowering serum cholesterol levels in a subject comprising administering to a subject an effective amount of at least one antibody or antibody fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method of lowering serum cholesterol levels in a subject comprising administering to a subject an effective amount of at least one antibody or antibody fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method of lowering serum cholesterol levels in a subject comprising administering to a subject an effective amount of at least one antibody or antibody fragment according to the invention simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspects, the invention comprises a method of increasing LDLR protein levels in a subject by administering to a subject an effective amount of at least one isolated antibody or antibody fragment according to the invention as provided herein.

In some aspects, the invention comprises a method of increasing LDLR protein levels in a subject by administering to a subject an effective amount of at least one antibody or antibody fragment according to the invention simultaneously or sequentially with an agent that elevates the availability of LDLR protein or which blocks or inhibits cholesterol synthesis. In some embodiments, the agent that blocks or inhibits cholesterol synthesis comprises a statin. In some embodiments, the statin is selected from the group consisting of atorvastatin, cerivastatin, fluvastatin, lovastatin, mevastatin, pitavastatin, pravastatin, rosuvastatin, simvastatin, and some combination thereof. In some embodiments, the statin is combined with niacin, an absorption inhibitor (ezetimibe), a lipid modifying agent, or a combination thereof. In some embodiments, the agent that elevates the availability of LDLR protein levels comprises certain cytokines like oncostatin M, estrogen, and/or certain herbal ingredients such as berberine.

In some aspects, the invention comprises a method of increasing LDLR protein levels in a subject by administering to a subject an effective amount of at least one antibody or antibody fragment according to the invention simultaneously or sequentially with an agent that increases high density lipoprotein (HDL) and/or decreases triglyceride levels. In some embodiments, the agent that increases high density lipoprotein (HDL) and/or decreases triglyceride levels comprises a fibrate. In some embodiments, the fibrate is selected from the group consisting of bezafibrate, ciprofibrate, clofibrate, gemfibrozil, fenofibrate, and some combination thereof.

In some aspects, the invention comprises a method of increasing LDLR protein levels in a subject by administering to a subject an effective amount of at least one antibody or antibody fragment according to the invention simultaneously or sequentially with a bile acid sequestering agent. In some embodiments, the bile sequestering agent is selected from the group consisting of cholestyramine, colesevelam, colestipol, and some combination thereof.

In some aspects, the invention comprises a method of increasing LDLR protein levels in a subject by administering to a subject an effective amount of at least one antibody or antibody fragment according to the invention simultaneously or sequentially with an agent that decreases cholesterol absorption in the intestine. In some embodiments, the agent that decreases cholesterol absorption in the intestine is ezetimibe.

In some aspects, the invention comprises a method of increasing LDLR protein levels in a subject by administering to a subject an effective amount of at least one antibody or antibody fragment according to the invention simultaneously or sequentially with an agent that decreases cholesterol levels. In some embodiments, the agent that decreases cholesterol levels is selected from the group consisting of certain anti-psychotic agents, certain HIV protease inhibitors, dietary factors such as high fructose, sucrose, cholesterol or certain fatty acids and certain nuclear receptor agonists and antagonists for RXR, RAR, LXR, FXR.

In some aspects, the invention comprises a method of increasing LDLR protein levels in a subject by administering to a subject an effective amount of at least one antibody or antibody fragment according to the invention simultaneously or sequentially with an agent that increases HDL levels. In some embodiments, the agent that increases HDL levels is niacin, also known as nicotinic acid. In some embodiments, the niacin is a slow-release formulation.

In some aspects, the invention comprises a method of increasing LDLR protein levels in a subject by administering to a subject an effective amount of at least one antibody or antibody fragment according to the invention simultaneously or sequentially with an agent that inhibits hepatic triglyceride production and/or very low density lipoprotein (VLDL) secretions. In some embodiments, the agent that inhibits hepatic triglyceride production and/or very low density lipoprotein (VLDL) secretions is acipimox.

In some aspects, the invention comprises a method of increasing LDLR protein levels in a subject by administering to a subject an effective amount of at least one antibody or antibody fragment according to the invention simultaneously or sequentially with an agent that decreases lipid absorption in the intestine. In some embodiments, the agent that decreases lipid absorption in the intestine is selected from the group consisting of orlistat, lipstatin, and some combination thereof.

In some aspects, the invention comprises a method of increasing LDLR protein levels in a subject by administering to a subject an effective amount of at least one antibody or antibody fragment according to the invention simultaneously or sequentially with an agent that is an anti-hypertensive and/or treats angina. In some embodiments, the agent that is an anti-hypertensive and/or treats angina is amlodipine.

In some aspects, the invention comprises a method of increasing LDLR protein levels in a subject by administering to a subject an effective amount of at least one antibody or antibody fragment according to the invention simultaneously or sequentially with at least one other agent, wherein the combination allows for mitigation of undesirable side-effects of at least one other agent. In some embodiments, the antibody or antibody fragment according to the invention and the at least one other agent are administered concurrently. In some embodiments, the antibody or antibody fragment according to the invention and at least one other agent are not administered simultaneously, with the antibody or antibody fragment according to the invention being administered before or after the at least one other agent is administered.

In some aspects, the invention comprises a neutralizing antibody that binds to PCSK9 and reduces a low density lipoprotein receptor (LDLR) lowering effect of PCSK9 on LDLR. In some embodiments, the antibody specifically binds to PCSK9. In some embodiments, the antibody binds to the catalytic domain of PCSK9.

In some aspects, the invention comprises an isolated neutralizing antibody or antibody fragment according to the invention that binds to a PCSK9 protein comprising the amino acid sequence of SEQ ID NO: 961, wherein the neutralizing antibody or antibody fragment according to the invention decreases the ability of PCSK9 to lower LDLR levels. In some embodiments, the antibody or antibody fragment according to the invention is a LDLR non-competitive neutralizing antibody or antibody fragment according to the invention. In some embodiments, the antibody or antibody fragment according to the invention is a LDLR competitive neutralizing antibody or antibody fragment according to the invention.

In some aspects, the invention comprises an isolated neutralizing antibody or antibody fragment according to the invention that binds to a PCSK9 protein comprising the amino acid sequence of SEQ ID NO: 962, wherein the neutralizing antibody or antibody fragment according to the invention decreases the LDLR lowering effect of PCSK9 on LDLR. In some embodiments, the antibody or antibody fragment according to the invention is a LDLR non-competitive neutralizing antibody or antibody fragment according to the invention. In some embodiments, the antibody or antibody fragment according to the invention is a LDLR competitive neutralizing antibody or antibody fragment according to the invention.

In some aspects, the invention comprises a composition comprising a crystallized PCSK9 protein and an antibody or antibody fragment according to the invention that binds to PCSK9. The composition comprises the crystallized PCSK9 protein is such that the three dimensional structure of the PCSK9 protein can be determined to a resolution of about 2.2 angstroms or better. In some embodiments, the antibody or antibody fragment according to the invention is an antibody or a fragment thereof.

In some aspects, the invention comprises the use of an antibody or antibody fragment according to the invention as described herein, in the preparation of a medicament for the lowering of serum cholesterol.

In some aspects, the invention comprises the use of an antibody or antibody fragment according to the invention as described herein, in the preparation of a medicament for treating or preventing a condition associated with elevated serum cholesterol levels in a subject.

The inventive antibodies and fragments thereof may be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Antibodies or fragments thereof may also be chemically modified to provide additional advantages such as increased solubility, stability and circulating time (in vivo half-life) of the polypeptide, or decreased immunogenicity (See U.S. Pat. No. 4,179,337). The chemical moieties for derivitization may be selected from water soluble polymers such as polyethylene glycol, ethylene glycol/propylene glycol copolymers, carboxymethylcellulose, dextran, polyvinyl alcohol and the like. The antibodies and fragments thereof may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kDa. Branched polyethylene glycols are described, for example, in U.S. Pat. No. 5,643,575; Morpurgo et al., Appl. Biochem. Biotechnol. 56:59-72 (1996); Vorobjev et al., Nucleosides Nucleotides 18:2745-2750 (1999); and Caliceti et al., Bioconjug. Chem. 10:638-646 (1999), the disclosures of each of which are incorporated herein by reference.

There are a number of attachment methods available to those skilled in the art, See e.g., EP 0 401 384, herein incorporated by reference (coupling PEG to G-CSF), See also Malik et al., Exp. Hematol. 20:1028-1035 (1992) (reporting pegylation of GM-CSF using tresyl chloride). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to polypeptides via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) or to more than one type of amino acid residue (e.g., lysine, histidine, aspartic acid, glutamic acid, cysteine and combinations thereof).

Alternatively, antibodies or fragments thereof may have increased in vivo half lives via fusion with albumin (including but not limited to recombinant human serum albumin or fragments or variants thereof (See, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)) or other circulating blood proteins such as transferrin or ferritin. In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. Polynucleotides encoding fusion proteins of the invention are also encompassed by the invention.

Regarding detectable moieties, further exemplary enzymes include, but are not limited to, horseradish peroxidase, acetylcholinesterase, alkaline phosphatase, beta-galactosidase and luciferase. Further exemplary fluorescent materials include, but are not limited to, rhodamine, fluorescein, fluorescein isothiocyanate, umbelliferone, dichlorotriazinylamine, phycoerythrin, and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine 125 ($^{125}$I), Carbon 14 ($^{14}$C), Sulfur 35 ($^{35}$S), Tritium ($^{3}$H) and Phosphorus 32 ($^{32}$P).

Regarding functional moieties, exemplary cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, caminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine and bleomycin. Toxic enzymes from plants and bacteria such as ricin, diphtheria toxin and *Pseudomonas* toxin may be conjugated to the humanized or chimeric antibodies, or binding fragments thereof, to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the antibody, or binding fragments thereof, with or without the use of a complex-forming agent. Such radionuclides include beta-emitters such as Phosphorus-32 ($^{32}$P), Scandium-47 ($^{47}$Sc), Copper-67 ($^{67}$Cu), Gallium-67 ($^{67}$Ga), Yttrium-88 ($^{88}$Y), Yttrium-90 ($^{90}$Y), Iodine-125 ($^{125}$I), Iodine-131 ($^{131}$I), Samarium-153 ($^{153}$Sm), Lutetium-177 ($^{177}$Lu), Rhenium-186 ($^{186}$Re) or Rhenium-188 ($^{188}$Re), and alpha-emitters such as Astatine-211 ($^{211}$At), Lead-212 ($^{212}$Pb), Bismuth-212 ($^{212}$Bi) or -213 ($^{213}$Bi) or Actinium-225 ($^{225}$Ac).

Methods are known in the art for conjugating an antibody or binding fragment thereof to a detectable moiety and the like, such as for example those methods described by Hunter et al, Nature 144:945 (1962); David et al, Biochemistry 13:1014 (1974); Pain et al, J. Immunol. Meth. 40:219 (1981); and Nygren, J., Histochem. and Cytochem. 30:407 (1982).

Embodiments described herein further include variants and equivalents that are substantially homologous to the antibodies, antibody fragments, diabodies, SMIPs, camelbodies, nanobodies, IgNAR, polypeptides, variable regions and CDRs set forth herein. These may contain, e.g., conservative substitution mutations, (i.e., the substitution of one or more amino acids by similar amino acids). For example, conservative substitution refers to the substitution of an amino acid with another within the same general class, e.g., one acidic amino acid with another acidic amino acid, one basic amino acid with another basic amino acid, or one neutral amino acid by another neutral amino acid. What is intended by a conservative amino acid substitution is well known in the art.

In another embodiment, the invention contemplates polypeptide sequences having at least 90% or greater sequence homology to any one or more of the polypeptide sequences of antibody fragments, variable regions and CDRs set forth herein. More preferably, the invention contemplates polypeptide sequences having at least 95% or greater sequence homology, even more preferably at least 98% or greater sequence homology, and still more preferably at least 99% or greater sequence homology to any one or more of the polypeptide sequences of antibody fragments, variable regions and CDRs set forth herein. Methods for determining homology between nucleic acid and amino acid sequences are well known to those of ordinary skill in the art.

In another embodiment, the invention further contemplates the above-recited polypeptide homologs of the antibody fragments, variable regions and CDRs set forth herein further having anti-PCSK9 activity. Non-limiting examples of anti-PCSK9 activity are set forth herein.

In another embodiment, the invention further contemplates the generation and use of anti-idiotypic antibodies that bind any of the foregoing sequences. In an exemplary embodiment, such an anti-idiotypic antibody could be administered to a subject who has received an anti-PCSK9 antibody to modulate, reduce, or neutralize, the effect of the anti-PCSK9 antibody. Such anti-idiotypic antibodies could also be useful for treatment of an autoimmune disease characterized by the presence of anti-PCSK9 antibodies. A further exemplary use of such anti-idiotypic antibodies is for detection of the anti-PCSK9 antibodies of the present invention, for example to monitor the levels of the anti-PCSK9 antibodies present in a subject's blood or other bodily fluids.

The present invention also contemplates anti-PCSK9 antibodies comprising any of the polypeptide or polynucleotide sequences described herein substituted for any of the other polynucleotide sequences described herein. For example, without limitation thereto, the present invention contemplates antibodies comprising the combination of any of the variable light chain and variable heavy chain sequences described herein, and further contemplates antibodies resulting from substitution of any of the CDR sequences described herein for any of the other CDR sequences described herein.

Additional Exemplary Embodiments of the Invention

In another embodiment, the invention contemplates one or more anti-human PCSK9 antibodies or antibody fragments thereof which specifically bind to the same linear or conformational epitope(s) and/or competes for binding to the same or overlapping linear or conformational epitope(s) on an intact human PCSK9 polypeptide or fragment thereof as an anti-human PCSK9 antibody selected from Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23, or Ab24. In a preferred embodiment, the anti-human PCSK9 antibody or fragment thereof specifically binds to the same linear or conformational epitope(s) and/or competes for binding to the same linear or conformational epitope(s) on an intact human PCSK9 polypeptide or a fragment thereof as Ab7.

A preferred embodiment of the invention is directed to chimeric or humanized antibodies and fragments thereof (including Fab fragments) having binding specificity for PCSK9 and inhibiting biological activities mediated by the binding of PCSK9 to the LDLR.

In certain instances, PCSK9 activity correlates with a number of human disease states. For example, in certain instances, too much or too little PCSK9 activity correlates with certain conditions, such as hypercholesterolemia. Therefore, in certain instances, modulating PCSK9 activity can be therapeutically useful. In certain embodiments, a neutralizing antibody or antibody fragment according to the invention to PCSK9 is used to modulate at least one PCSK9 activity (e.g., binding to LDLR). Such methods can treat and/or prevent and/or reduce the risk of disorders that relate to elevated serum cholesterol levels or in which elevated cholesterol levels are relevant.

As will be appreciated by one of skill in the art, in light of the present disclosure, disorders that relate to, involve, or can be influenced by varied cholesterol, LDL, or LDLR levels can be addressed by various embodiments of the antibody or antibody fragment according to the invention. In some embodiments, a "cholesterol related disorder" (which includes "serum cholesterol related disorders") includes any one or more of the following: hypercholesterolemia, heart disease, metabolic syndrome, diabetes, coronary heart disease, stroke, cardiovascular diseases, Alzheimer's disease and generally dyslipidemias, which can be manifested, for example, by an elevated total serum cholesterol, elevated LDL, elevated triglycerides, elevated VLDL, and/or low HDL. Some non-limiting examples of primary and secondary dyslipidemias that can be treated using an antibody or antibody fragment according to the invention, either alone, or in combination with one or more other agents include the metabolic syndrome, diabetes mellitus, familial combined hyperlipidemia, familial hypertriglyceridemia, familial hypercholesterolemias, including heterozygous hypercholesterolemia, homozygous hypercholesterolemia, familial defective apolipoprotein B-100; polygenic hypercholesterolemia; remnant removal disease, hepatic lipase deficiency; dyslipidemia secondary to any of the following: dietary indiscretion, hypothyroidism, drugs including estrogen and progestin therapy, beta-blockers, and thiazide diuretics; nephrotic syndrome, chronic renal failure, Cushing's syndrome, primary biliary cirrhosis, glycogen storage diseases, hepatoma, cholestasis, acromegaly, insulinoma, isolated growth hormone deficiency, and alcohol-induced hypertriglyceridemia. antibody or antibody fragment according to the invention can also be useful in preventing or treating atherosclerotic diseases, such as, for example, coronary heart disease, coronary artery disease, peripheral arterial disease, stroke (ischaemic and hemorrhagic), angina pectoris, or cerebrovascular disease and acute coronary syndrome, myocardial infarction. In some embodiments, the antibody or antibody fragment according to the invention is useful in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries. In some embodiments, the antibody or antibody fragment according to the invention and methods can be used to reduce the risk of recurrent cardiovascular events.

As will be appreciated by one of skill in the art, diseases or disorders that are generally addressable (either treatable or preventable) through the use of statins can also benefit from the application of the instant antibody or antibody fragment according to the invention. In addition, in some embodiments, disorders or disease that can benefit from the prevention of cholesterol synthesis or increased LDLR expression can also be treated by various embodiments of the antibody or antibody fragment according to the invention. In addition, as will be appreciated by one of skill in the art, the use of the anti-PCSK9 antibodies can be especially useful in the treatment of diabetes. Not only is diabetes a risk factor for coronary heart disease, but insulin increases the expression of PCSK9. That is, people with diabetes have elevated plasma lipid levels (which can be related to high PCSK9 levels) and can benefit from lowering those levels. This is generally discussed in more detail in Costet et al. ("Hepatic PCSK9 Expression is Regulated by Nutritional Status via Insulin and Sterol Regulatory Element-binding Protein 1C", J. Biol. Chem., 281: 6211-6218, 2006), the entirety of which is incorporated herein by reference.

In some embodiments, the antibody or antibody fragment according to the invention is administered to those who have diabetes mellitus, abdominal aortic aneurysm, atherosclerosis and/or peripheral vascular disease in order to decrease their serum cholesterol levels to a safer range. In some embodiments, the antibody or antibody fragment according to the invention is administered to patients at risk of developing any of the herein described disorders. In some embodiments, the antibody or antibody fragment according to the invention are administered to subjects that smoke, have hypertension or a familial history of early heart attacks.

In some embodiments, a subject is administered an antibody or antibody fragment according to the invention if they are at a moderate risk or higher on the 2004 NCEP treatment goals. In some embodiments, the antibody or antibody fragment according to the invention is administered to a subject if the subject's LDL-C cholesterol level is greater than 160 mg/dL. In some embodiments, the antibody or antibody fragment according to the invention is administered if the subjects LDL-C cholesterol level is greater than 130 (and they have a moderate or moderately high risk according to the 2004 NCEP treatment goals). In some embodiments, the antibody or antibody fragment according to the invention is administered if the subjects LDL-C cholesterol level is greater than 100 (and they have a high or very high risk according to the 2004 NCEP treatment goals).

A physician will be able to select an appropriate treatment indications and target lipid levels depending on the individual profile of a particular patient. One well-accepted standard for guiding treatment of hyperlipidemia is the Third Report of the National Cholesterol Education Program (NCEP) Expert Panel on Detection, Evaluation, and Treatment of the High Blood Cholesterol in Adults (Adult Treatment Panel III) Final Report, National Institutes of Health, NIH Publication No. 02-5215 (2002), the printed publication of which is hereby incorporated by reference in its entirety.

In some embodiments, antibody or antibody fragment according to the invention to PCSK9 are used to decrease the amount of PCSK9 activity from an abnormally high level or even a normal level. In some embodiments, antibody or antibody fragment according to the invention to PCSK9 are used to treat or prevent hypercholesterolemia and/or in the preparation of medicaments therefore and/or for other cholesterol related disorders (such as those noted herein). In certain embodiments, an antibody or antibody fragment according to the invention to PCSK9 is used to treat or prevent conditions such as hypercholesterolemia in which PCSK9 activity is normal. In such conditions, for example, reduction of PCSK9 activity to below normal can provide a therapeutic effect.

In some embodiments, more than one antibody or antibody fragment according to the invention to PCSK9 is used to modulate PCSK9 activity.

In certain embodiments, methods are provided of treating a cholesterol related disorder, such as hypercholesterolemia comprising administering a therapeutically effective amount of one or more antibody or antibody fragment according to the invention to PCSK9 and another therapeutic agent.

Pharmaceutical or diagnostic compositions of the invention can be administered in combination therapy, i.e., combined with other agents. In certain embodiments, the combination therapy comprises an antibody or antibody fragment according to the invention capable of binding PCSK9, in combination with at least one anti-cholesterol agent. Agents include, but are not limited to, in vitro synthetically prepared chemical compositions, antibodies, antigen binding regions, and combinations and conjugates thereof. In certain embodiments, an agent can act as an agonist, antagonist, allosteric modulator, or toxin. In certain embodiments, an agent can act to inhibit or stimulate its target (e.g., receptor or enzyme activation or inhibition), and thereby promote increased expression of LDLR or decrease serum cholesterol levels.

In certain embodiments, an antibody or antibody fragment according to the invention to PCSK9 can be administered prior to, concurrent with, and subsequent to treatment with a cholesterol-lowering (serum and/or total cholesterol) agent. In certain embodiments, an antibody or antibody fragment according to the invention to PCSK9 can be administered prophylactically to prevent or mitigate the onset of hypercholesterolemia, heart disease, diabetes, and/or any of the cholesterol related disorder. In certain embodiments, an antibody or antibody fragment according to the invention to PCSK9 can be administered for the treatment of an existing hypercholesterolemia condition. In some embodiments, the antibody or antibody fragment according to the invention delays the onset of the disorder and/or symptoms associated with the disorder. In some embodiments, the antibody or antibody fragment according to the invention is provided to a subject lacking any symptoms of any one of the cholesterol related disorders or a subset thereof.

In certain embodiments, an antibody or antibody fragment according to the invention to PCSK9 is used with particular therapeutic agents to treat various cholesterol related disorders, such as hypercholesterolemia. In certain embodiments, in view of the condition and the desired level of treatment, two, three, or more agents can be administered. In certain embodiments, such agents can be provided together by inclusion in the same formulation. In certain embodiments, such agent(s) and an antibody or antibody fragment according to the invention to PCSK9 can be provided together by inclusion in the same formulation. In certain embodiments, such agents can be formulated separately and provided together by inclusion in a treatment kit. In certain embodiments, such agents and an antibody or antibody fragment according to the invention to PCSK9 can be formulated separately and provided together by inclusion in a treatment kit. In certain embodiments, such agents can be provided separately. In certain embodiments, when administered by gene therapy, the genes encoding protein agents and/or an antibody or antibody fragment according to the invention to PCSK9 can be included in the same vector. In certain embodiments, the genes encoding protein agents and/or an antibody or antibody fragment according to the invention to PCSK9 can be under the control of the same promoter region. In certain embodiments, the genes encoding protein agents and/or an antibody or antibody fragment according to the invention to PCSK9 can be in separate vectors.

In certain embodiments, the invention provides for pharmaceutical or diagnostic compositions comprising an antibody or antibody fragment according to the invention to PCSK9 together with a pharmaceutically acceptable diluent, carrier, solubilizer, emulsifier, or preservative.

In certain embodiments, the invention provides for pharmaceutical or diagnostic compositions comprising an antibody or antibody fragment according to the invention to PCSK9 and a therapeutically effective amount of at least one additional therapeutic agent, together with a pharmaceutically acceptable diluent, carrier, solubilizer, emulsifier, preservative and/or adjuvant.

In certain embodiments, an antibody or antibody fragment according to the invention to PCSK9 can be used with at least one therapeutic agent for inflammation. In certain embodiments, an antibody or antibody fragment according to the invention to PCSK9 can be used with at least one therapeutic agent for an immune disorder. Exemplary therapeutic agents for inflammation and immune disorders include, but are not limited to cyclooxygenase type 1 (COX-1) and cyclooxygenase type 2 (COX-2) inhibitors, small molecule modulators of 38 kDa mitogen-activated protein kinase (p38-MAPK); small molecule modulators of intracellular molecules involved in inflammation pathways, wherein such intracellular molecules include, but are not limited to, jnk, IKK, NF-κB, ZAP70, and lck. Certain exemplary therapeutic agents for inflammation are described, e.g., in C. A. Dinarello & L. L. Moldawer Proinflammatory and Anti-Inflammatory Cytokines in Rheumatoid Arthritis: A Primer for Clinicians Third Edition (2001) Amgen Inc. Thousand Oaks, Calif.

In certain embodiments, pharmaceutical or diagnostic compositions will include more than one different antibody or antibody fragment according to the invention to PCSK9. In certain embodiments, pharmaceutical or diagnostic compositions will include more than one antibody or antibody fragment according to the invention to PCSK9 wherein the antibody or antibody fragment according to the invention to PCSK9 bind more than one epitope. In some embodiments, the various antibody or antibody fragment according to the invention will not compete with one another for binding to PCSK9.

In certain embodiments, acceptable formulation materials preferably are nontoxic to recipients at the dosages and concentrations employed. In some embodiments, the formulation material(s) are for s.c. and/or I.V. administration. In certain embodiments, the pharmaceutical or diagnostic composition can contain formulation materials for modifying, maintaining or preserving, for example, the pH, osmolarity, viscosity, clarity, color, isotonicity, odor, sterility, stability, rate of dissolution or release, adsorption or penetration of the composition. In certain embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. (Remington's Pharmaceutical Sciences, 18 th Edition, A. R. Gennaro, ed., Mack Publishing Company (1995). In some embodiments, the formulation comprises PBS; 20 mM NaOAC, pH 5.2, 50 mM NaCl; and/or 10 mM NAOAC, pH 5.2, 9% Sucrose.

The invention is also directed to an anti-PCSK9 antibody that binds with the same PCSK9 epitope and/or competes with an anti-PCSK9 antibody for binding to PCSK9 as an antibody or antibody fragment disclosed herein, including but not limited to an anti-PCSK9 antibody selected from Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23, or Ab24.

In another embodiment, the invention is also directed to an isolated anti-PCSK9 antibody or antibody fragment comprising one or more of the CDRs contained in the $V_H$ polypeptide sequences selected from: SEQ ID NO: 2, SEQ ID NO: 42, SEQ ID NO: 82, SEQ ID NO: 122, SEQ ID NO: 162, SEQ ID NO: 202, SEQ ID NO: 242, SEQ ID NO: 282, SEQ ID NO: 322, SEQ ID NO: 362, SEQ ID NO: 402, SEQ ID NO: 442, SEQ ID NO: 482, SEQ ID NO: 522, SEQ ID NO: 562, SEQ ID NO: 602, SEQ ID NO: 642, SEQ ID NO: 682, SEQ ID NO: 722, SEQ ID NO: 762, SEQ ID NO: 802, SEQ ID NO: 842, SEQ ID NO: 882, SEQ ID NO: 922, or a variant thereof, and/or one or more of the CDRs contained in the $V_L$ polypeptide sequences selected from: SEQ ID NO: 22, SEQ ID NO: 62, SEQ ID NO: 102, SEQ ID NO: 142, SEQ ID NO: 182, SEQ ID NO: 222, SEQ ID NO: 262, SEQ ID NO: 302, SEQ ID NO: 342, SEQ ID NO: 382, SEQ ID NO: 422, SEQ ID NO: 462, SEQ ID NO: 502, SEQ ID NO: 542, SEQ ID NO: 582, SEQ ID NO: 622, SEQ ID NO: 662, SEQ ID NO: 702, SEQ ID NO: 742, SEQ ID NO: 782, SEQ ID NO: 822, SEQ ID NO: 862, SEQ ID NO: 902, SEQ ID NO: 942, or a variant thereof.

In one embodiment of the invention, the anti-human PCSK9 antibody comprises at least 2 complementarity determining regions (CDRs) in each the variable light and the variable heavy regions which are identical to those contained in an anti-human PCSK9 antibody selected from Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23, or Ab24.

In a preferred embodiment, the anti-human PCSK9 antibody comprises at least 2 complementarity determining regions (CDRs) in each the variable light and the variable heavy regions which are identical to the CDRs contained in an anti-human PCSK9 antibody selected from Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23, or Ab24. In another embodiment, all of the CDRs of the anti-human PCSK9 antibody are identical to the CDRs contained in an anti-human PCSK9 antibody selected from Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab20, Ab21, Ab22, Ab23, or Ab24.

The invention further contemplates that the one or more anti-human PCSK9 antibodies discussed above are aglycosylated; or lack or substantially lack N and/r O-glyosylation, e.g., as the result of an Fc region codification. Also, the subject antibodies may contain an Fc region that has been modified to alter the effector function, half-life, proteolysis or other properties of the antibody; especially human, humanized or chimeric antibodies according to the invention may contain such modified Fc regions.

The invention further contemplates one or more anti-human PCSK9 antibodies wherein the framework regions (FRs) in the variable light region and the variable heavy regions of said antibody respectively are human FRs which are unmodified or which have been modified by the substitution of one or more human FR residues in the variable light or heavy chain region with the corresponding FR residues of the parent rabbit antibody, and wherein said human FRs have been derived from human variable heavy and light chain antibody sequences which have been selected from a library of human germline antibody sequences based on their high level of homology to the corresponding rabbit variable heavy or light chain regions relative to other human germline antibody sequences contained in the library.

In one embodiment of the invention, the anti-human PCSK9 antibody or fragment specifically binds to PCSK9 expressing human cells and/or to circulating soluble PCSK9 molecules in vivo, including PCSK9 expressed on or by human cells in a patient with a disease associated with cells that express PCSK9.

The invention further contemplates anti-human PCSK9 antibodies or fragments directly or indirectly attached to a detectable label or therapeutic agent.

The invention also contemplates one or more nucleic acid sequences which result in the expression of an anti-human PCSK9 antibody or antibody fragment as set forth above, including those comprising, or alternatively consisting of, yeast or human preferred codons. The invention also contemplates vectors (including plasmids or recombinant viral vectors) comprising said nucleic acid sequence(s). The invention also contemplates host cells or recombinant host cells expressing at least one of the antibodies set forth above, including e.g., mammalian, yeast, fungal, bacterial, plant, avian, and insect cells. In a preferred embodiment, the host cell is a yeast or fungal or mammalian cell. In a further preferred embodiment, the yeast cell is a diploidal yeast cell. In a more preferred embodiment, the yeast cell is a *Pichia* yeast.

The anti-PCSK9 activity of the anti-PCSK9 antibodies of the present invention, and fragments thereof having binding specificity to PCSK9, may also be described by their strength of binding or their affinity for PCSK9. In one embodiment of the invention, the anti-PCSK9 antibodies of the present invention, and fragments thereof having binding specificity to PCSK9, bind to PCSK9 with a dissociation constant ($K_d$) of less than or equal to $10^{-2}$ M, $5 \times 10^{-3}$ M, $10^{-3}$ M, $5 \times 10^{-4}$ M, $10^{-4}$ M, $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M. Preferably, the anti-PCSK9 antibodies and fragments thereof bind PCSK9 with a dissociation constant of less than or equal to $10^{-11}$ M, $5 \times 10^{-12}$ M, or $10^{-12}$ M. In another embodiment of the invention, the anti-PCSK9 antibodies of the present invention, and fragments thereof having binding specificity to PCSK9, bind to a linear or conformational PCSK9 epitope.

In another embodiment of the invention, the anti-PCSK9 activity of the anti-PCSK9 antibodies of the present invention, and fragments thereof having binding specificity to PCSK9, bind to PCSK9 with an off-rate of less than or equal to $10^{-4}$ S$^{-1}$, $5 \times 10^{-5}$ S$^{-1}$, $10^{-5}$ S$^{-1}$, $5 \times 10^{-6}$ S$^{-1}$, $10^{-6}$ S$^{-1}$, $5 \times 10^{-7}$ S$^{-1}$, or $10^{-7}$ S$^{-1}$.

In a further embodiment of the invention, the anti-PCSK9 activity of the anti-PCSK9 antibodies of the present invention, and fragments thereof having binding specificity to PCSK9, exhibit anti-PCSK9 activity by preventing, ameliorating or reducing the symptoms of, or alternatively treating, diseases and disorders associated with PCSK9. Non-limiting examples of diseases and disorders associated with PCSK9 are set forth herein.

Polynucleotides Encoding Anti-PCSK9 Antibody Polypeptides

Antibody Ab1

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 1:

(SEQ ID NO: 11)
cagtcggtggaggagtccgggggtcgcctggtcacgcctgggacacccc tgacactcacctgcacagtctctggattctccctcagtagctactggat gacttgggtccgccaggctccagggaaggggctggaatacatcggaatc attagtagtagtggtagcacatactacgcgacctgggcgaaaggccgat tcaccatctccaaaacctcgtcgaccacggtggatctggaaatcaccag tccgacaaccgaggacacggccacctatttctgtgccagagactctgct tttagttctggtttggaattcaacatctggggcccgggcaccctcgtca ccgtctcgagcgcctccaccaagggcccatcggtcttcccctggcacc ctcctccaagagcacctctgggggcacagcggccctgggctgcctggtc aaggactacttccccgaaccggtgacggtgtcgtggaactcaggcgccc tgaccagcggcgtgcacaccttcccggctgtcctacagtcctcaggact ctactccctcagcagcgtggtgaccgtgccctccagcagcttgggcacc cagacctacatctgcaacgtgaatcacaagcccagcaacaccaaggtgg acaagagagttgagcccaaatcttgtgacaaaactcacacatgcccacc gtgcccagcacctgaactcctggggggaccgtcagtcttcctcttccc ccaaaacccaaggacaccctcatgatctcccggacccctgaggtcacat gcgtggtggtggacgtgagccacgaagaccctgaggtcaagttcaactg gtacgtggacggcgtggaggtgcataatgccaagacaaagccgcgggag gagcagtacgccagcacgtaccgtgtggtcagcgtcctcaccgtcctgc accaggactggctgaatggcaaggagtacaagtgcaaggtctccaacaa agcccctcccagccccatcgagaaaaccatctccaaagccaaagggcag ccccgagaaccacaggtgtacaccctgcccccatcccgggaggagatga ccaagaaccaggtcagcctgacctgcctggtcaaaggcttctatcccag cgacatcgccgtggagtgggagagcaatgggcagccggagaacaactac aagaccacgcctcccgtgctggactccgacggctccttcttcctctaca gcaagctcaccgtggacaagagcaggtggcagcaggggaacgtcttctc atgctccgtgatgcatgaggctctgcacaaccactacacgcagaagagc ctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 2:

(SEQ ID NO: 12)
cagtcggtggaggagtccgggggtcgcctggtcacgcctgggacacccc tgacactcacctgcacagtctctggattctccctcagtagctactggat gacttgggtccgccaggctccagggaaggggctggaatacatcggaatc attagtagtagtggtagcacatactacgcgacctgggcgaaaggccgat tcaccatctccaaaacctcgtcgaccacggtggatctggaaatcaccag tccgacaaccgaggacacggccacctatttctgtgccagagactctgct tttagttctggtttggaattcaacatctggggcccgggcaccctcgtca ccgtctcgagc.

In another embodiment of the invention, polynucleotides of the invention comprise, or alternatively consist of, the following polynucleotide sequence encoding the constant heavy chain polypeptide sequence of SEQ ID NO: 10:

(SEQ ID NO: 20)
gcctccaccaagggcccatcggtcttcccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagcccctcccag ccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 21:

(SEQ ID NO: 31)
gcctatgatctgacccagactccagcctctgtgaggtagctgtgggag gcacagtcaccatcaagtgccaggccagtcagagtgtttatagtaactg gttatcctggtatcagcagaaaccagggcagcctcccaagctcctgatc tatgatgcatccgatctggcatctggggtcccatcgcggttcaaaggca gtggatctgggacacagttcactctcaccatcagcggcgtgcagtgtga cgatgctgccacttactactgtcagcaggggcagagtagtagtgatatt gataatactttcggcggagggaccgaggtggtggtcaaacgtacggtag cggccccatctgtcttcatcttcccgccatctgatgagcagttgaaatc tggaactgcctctgttgtgtgcctgctgaataacttctatcccagagag gccaaagtacagtggaaggtggataacgcctccaatcgggtaactccc aggagagtgtcacagagcaggacagcaaggacagcacctacagcctcag cagcaccctgacgctgagcaaagcagactacgagaaacacaaagtctac gcctgcgaagtcacccatcagggcctgagctcgcccgtcacaaagagct tcaacaggggagagtgt.

In another embodiment of the invention, polynucleotides of the invention comprise, or alternatively consist of, the following polynucleotide sequence encoding the variable light chain polypeptide sequence of SEQ ID NO: 22:

(SEQ ID NO: 32)
gcctatgatctgacccagactccagcctctgtggaggtagctgtgggag gcacagtcaccatcaagtgccaggccagtcagagtgtttatagtaactg gttatcctggtatcagcagaaaccagggcagcctcccaagctcctgatc tatgatgcatccgatctggcatctggggtcccatcgcggttcaaaggca gtggatctgggacacagttcactctcaccatcagcggcgtgcagtgtga cgatgctgccacttactactgtcagcaggggcagagtagtagtgatatt gataatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 30:

(SEQ ID NO: 40)
cgtacggtagcggccccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 14; SEQ ID NO: 16; and SEQ ID NO: 18, which correspond to polynucleotides encoding the complementarity-determining regions (CDRs, or hypervariable regions) of the heavy chain sequence of SEQ ID NO: 1 or the variable heavy chain sequence of SEQ ID NO: 2, and/or one or more of the polynucleotide sequences of SEQ ID NO: 34; SEQ ID NO: 36; and SEQ ID NO: 38, which correspond to the complementarity-determining regions (CDRs, or hypervariable regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 13; SEQ ID NO: 15; SEQ ID NO: 17; and SEQ ID NO: 19, which correspond to polynucleotides encoding the framework regions (FRs or constant regions) of the heavy chain sequence of SEQ ID NO: 1 or the variable heavy chain sequence of SEQ ID NO: 2, and/or one or more of the polynucleotide sequences of SEQ ID NO: 33; SEQ ID NO: 35; SEQ ID NO: 37; and SEQ ID NO: 39, which correspond to the framework regions (FRs or constant regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 11 encoding the heavy chain sequence of SEQ ID NO: 1; the polynucleotide SEQ ID NO: 12 encoding the variable heavy chain sequence of SEQ ID NO: 2; the polynucleotide SEQ ID NO: 31 encoding the light chain sequence of SEQ ID NO: 21; the polynucleotide SEQ ID NO: 32 encoding the variable light chain sequence of SEQ ID NO: 22; polynucleotides encoding the complementarity-determining regions (SEQ ID NO: 14; SEQ ID NO: 16; and SEQ ID NO: 18) of the heavy chain sequence of SEQ ID NO: 1 or the variable heavy chain sequence of SEQ ID NO: 2; polynucleotides encoding the complementarity-determining regions (SEQ ID NO: 34; SEQ ID NO: 36; and SEQ ID NO: 38) of the light chain sequence of SEQ ID NO: 21 or the variable light chain sequence of SEQ ID NO: 22; polynucleotides encoding the framework regions (SEQ ID NO: 13; SEQ ID NO: 15; SEQ ID NO: 17; and SEQ ID NO: 19) of the heavy chain sequence of SEQ ID NO: 1 or the variable heavy chain sequence of SEQ ID NO: 2; and polynucleotides encoding the framework regions (SEQ ID NO: 33; SEQ ID NO: 35; SEQ ID NO: 37; and SEQ ID NO: 39) of the light chain sequence of SEQ ID NO: 21 or the variable light chain sequence of SEQ ID NO: 22.

In a preferred embodiment of the invention, polynucleotides of the invention comprise, or alternatively consist of, polynucleotides encoding Fab (fragment antigen binding) fragments having binding specificity for PCSK9. With respect to antibody Ab1, the polynucleotides encoding the full length Ab1 antibody comprise, or alternatively consist of, the polynucleotide SEQ ID NO: 11 encoding the heavy chain sequence of SEQ ID NO: 1 and the polynucleotide SEQ ID NO: 31 encoding the light chain sequence of SEQ ID NO: 21.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab1 following expression of the full-length polynucleotides in a suitable host. In another embodiment of the invention, anti-PCSK9 antibodies such as Ab1 or Fab fragments thereof may be produced via expression of Ab1 polynucleotides in mammalian cells such as CHO, NSO or HEK 293 cells, fungal, insect, or microbial systems such as yeast cells (for example

Antibody Ab2

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 41:

(SEQ ID NO: 51)
cagtcggtggaggagtccgggggtcgcctggtcacgcctgggacacccct gacactcacctgcacagtctctggattctccctcagtagctatgcaatga gctgggtccgccaggctccagggaaggggctggaatggatcggaatcatt gatgctattgataacacatactacgcgagctgggcgaaaggccgattcac catctccaaaacctcgaccacggtggatctgaaaatgaccagtctgacaa ccggggacacggccacctatttctgtgccagagcctctattcttggttat agtattgctacgggctttaacatctggggcccagggaccctcgtcaccgt ctcgagcgcctccaccaagggcccatcggtcttcccctggcaccctcct ccaagagcacctctgggggcacagcggccctgggctgcctggtcaaggac tacttccccgaaccggtgacggtgtcgtggaactcaggcgccctgaccag cggcgtgcacaccttcccggctgtcctacagtcctcaggactctactccc tcagcagcgtggtgaccgtgccctccagcagcttgggcacccagacctac atctgcaacgtgaatcacaagcccagcaacaccaaggtggacaagagagt tgagcccaaatcttgtgacaaaactcacacatgcccaccgtgcccagcac ctgaactcctgggggaccgtcagtcttcctcttccccccaaaacccaag gacaccctcatgatctcccggacccctgaggtcacatgcgtggtggtgga cgtgagccacgaagaccctgaggtcaagttcaactggtacgtggacggcg tggaggtgcataatgccaagacaaagccgcgggaggagcagtacgccagc acgtaccgtgtggtcagcgtcctcaccgtcctgcaccaggactggctgaa tggcaaggagtacaagtgcaaggtctccaacaaagccctcccagccccca tcgagaaaccatctccaaagccaaagggcagccccgagaaccacaggtg tacaccctgcccccatcccgggaggagatgaccaagaaccaggtcagcct gacctgcctggtcaaaggcttctatcccagcgacatcgccgtggagtggg agagcaatgggcagccggagaacaactacaagaccacgcctcccgtgctg gactccgacggctccttcttcctctacagcaagctcaccgtggacaagag caggtggcagcaggggaacgtcttctcatgctccgtgatgcatgaggctc tgcacaaccactacacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 42:

(SEQ ID NO: 52)
cagtcggtggaggagtccgggggtcgcctggtcacgcctgggacacccc tgacactcacctgcacagtctctggattctccctcagtagctatgcaat gagctgggtccgccaggctccagggaaggggctggaatggatcggaatc attgatgctattgataacacatactacgcgagctgggcgaaaggccgat tcaccatctccaaaacctcgaccacggtggatctgaaaatgaccagtct gacaaccggggacacggccacctatttctgtgccagagcctctattctt ggttatagtattgctacgggctttaacatctggggcccagggaccctcg tcaccgtctcgagc.

In another embodiment of the invention, polynucleotides of the invention comprise, or alternatively consist of, the following polynucleotide sequence encoding the constant heavy chain polypeptide sequence of SEQ ID NO: 50:

(SEQ ID NO: 60)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 61:

(SEQ ID NO: 71)
gcctatgatatgacccagactccagcctctgtggaggtagctgtgggagg cacagtcaccatcaagtgccaggccagtcagagcattagtagccacttag cctggtatcagcagaaatcagggcagcctcccaagctcctgatctacagg gcatccactctggaatctggggtctcatcaaggttcaaaggcagtggatc tgggacagagttcactctcaccatcagcgacctggagtgtgccgatgctg ccacttactactgtcaacagggttatggtgttagtgatgttgataatggt -continued
```
ttcggcggagggaccgaggtggtggtcaaacgtacggtagcggcccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.
```

In another embodiment of the invention, polynucleotides of the invention comprise, or alternatively consist of, the following polynucleotide sequence encoding the variable light chain polypeptide sequence of SEQ ID NO: 62:

```
                                        (SEQ ID NO: 72)
gcctatgatatgacccagactccagcctctgtggaggtagctgtgggagg cacagtcaccatcaagtgccaggccagtcagagcattagtagccacttag cctggtatcagcagaaatcagggcagcctcccaagctcctgatctacagg gcatccactctggaatctggggtctcatcaaggttcaaaggcagtggatc tgggacagagttcactctcaccatcagcgacctggagtgtgccgatgctg ccacttactactgtcaacagggttatggtgttagtgatgttgataatggt ttcggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 70:

```
                                        (SEQ ID NO: 80)
cgtacggtagcggcccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 54; SEQ ID NO: 56; and SEQ ID NO: 58, which correspond to polynucleotides encoding the complementarity-determining regions (CDRs, or hypervariable regions) of the heavy chain sequence of SEQ ID NO: 41 or the variable heavy chain sequence of SEQ ID NO: 42, and/or one or more of the polynucleotide sequences of SEQ ID NO: 74; SEQ ID NO: 76; and SEQ ID NO: 78, which correspond to the complementarity-determining regions (CDRs, or hypervariable regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 53; SEQ ID NO: 55; SEQ ID NO: 57; and SEQ ID NO: 59, which correspond to polynucleotides encoding the framework regions (FRs or constant regions) of the heavy chain sequence of SEQ ID NO: 41 or the variable heavy chain sequence of SEQ ID NO: 42, and/or one or more of the polynucleotide sequences of SEQ ID NO: 73; SEQ ID NO: 75; SEQ ID NO: 77; and SEQ ID NO: 79, which correspond to the framework regions (FRs or constant regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 51 encoding the heavy chain sequence of SEQ ID NO: 41; the polynucleotide SEQ ID NO: 52 encoding the variable heavy chain sequence of SEQ ID NO: 42; the polynucleotide SEQ ID NO: 71 encoding the light chain sequence of SEQ ID NO: 61; the polynucleotide SEQ ID NO: 72 encoding the variable light chain sequence of SEQ ID NO: 62; polynucleotides encoding the complementarity-determining regions (SEQ ID NO: 54; SEQ ID NO: 56; and SEQ ID NO: 58) of the heavy chain sequence of SEQ ID NO: 41 or the variable heavy chain sequence of SEQ ID NO: 42; polynucleotides encoding the complementarity-determining regions (SEQ ID NO: 74; SEQ ID NO: 76; and SEQ ID NO: 78) of the light chain sequence of SEQ ID NO: 61 or the variable light chain sequence of SEQ ID NO: 62; polynucleotides encoding the framework regions (SEQ ID NO: 53; SEQ ID NO: 55; SEQ ID NO: 57; and SEQ ID NO: 59) of the heavy chain sequence of SEQ ID NO: 41 or the variable heavy chain sequence of SEQ ID NO: 42; and polynucleotides encoding the framework regions (SEQ ID NO: 73; SEQ ID NO: 75; SEQ ID NO: 77; and SEQ ID NO: 79) of the light chain sequence of SEQ ID NO: 61 or the variable light chain sequence of SEQ ID NO: 62.

In a preferred embodiment of the invention, polynucleotides of the invention comprise, or alternatively consist of, polynucleotides encoding Fab (fragment antigen binding) fragments having binding specificity for PCSK9. With respect to antibody Ab2, the polynucleotides encoding the full length Ab2 antibody comprise, or alternatively consist of, the polynucleotide SEQ ID NO: 51 encoding the heavy chain sequence of SEQ ID NO: 41 and the polynucleotide SEQ ID NO: 71 encoding the light chain sequence of SEQ ID NO: 61.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab2 following expression of the full-length polynucleotides in a suitable host. In another embodiment of the invention, anti-PCSK9 antibodies such as Ab2 or Fab fragments thereof may be produced via expression of Ab2 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab3

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 81:

```
                                          (SEQ ID NO: 91)
cagtcggtggaggagtccgggggtcgcctggtcacgcctggaggatccct gacactcacctgcacagcctctggattctccctcagtagctactacatga gctgggtccgccaggctccagggaaggggctggaatggatcggaatcatt tatcctagtggtagcacatactacgcgagctgggcgaaaggccgattcac catctccaaaacctcgaccacggtggatctgaaaatcaccagtccgacag tcgaggacacggccacctatttctgtgccagaggaggtgcttatgctact cttaacttgtggggcccgggcaccctcgtcaccgtctcgagcgcctccac caagggcccatcggtcttccccctggcaccctcctccaagagcacctctg ggggcacagcggccctgggctgcctggtcaaggactacttccccgaaccg gtgacggtgtcgtggaactcaggcgccctgaccagcggcgtgcacacctt cccggctgtcctacagtcctcaggactctactccctcagcagcgtggtga ccgtgccctccagcagcttgggcacccagacctacatctgcaacgtgaat cacaagcccagcaacaccaaggtggacaagagagttgagcccaaatcttg tgacaaaactcacacatgcccaccgtgcccagcacctgaactcctggggg gaccgtcagtcttcctcttccccccaaaacccaaggacaccctcatgatc tcccggacccctgaggtcacatgcgtggtggtggacgtgagccacgaaga ccctgaggtcaagttcaactggtacgtggacggcgtggaggtgcataatg ccaagacaaagccgcgggaggagcagtacgccagcacgtaccgtgtggtc agcgtcctcaccgtcctgcaccaggactggctgaatggcaaggagtacaa gtgcaaggtctccaacaaagccctcccagcccccatcgagaaaaccatct ccaaagccaaagggcagccccgagaaccacaggtgtacaccctgccccca tcccgggaggagatgaccaagaaccaggtcagcctgacctgcctggtcaa aggcttctatcccagcgacatcgccgtggagtgggagagcaatgggcagc cggagaacaactacaagaccacgcctcccgtgctggactccgacggctcc ttcttcctctacagcaagctcaccgtggacaagagcaggtggcagcaggg gaacgtcttctcatgctccgtgatgcatgaggctctgcacaaccactaca cgcagaagagcctctccctgtctccgggtaaa.
```

In another embodiment of the invention, the polynucleotides of the invention comprise, or alternatively consist of, the following polynucleotide sequence encoding the variable heavy chain polypeptide sequence of SEQ ID NO: 82:

```
                                          (SEQ ID NO: 92)
cagtcggtggaggagtccgggggtcgcctggtcacgcctggaggatccct gacactcacctgcacagcctctggattctccctcagtagctactacatga gctgggtccgccaggctccagggaaggggctggaatggatcggaatcatt tatcctagtggtagcacatactacgcgagctgggcgaaaggccgattcac catctccaaaacctcgaccacggtggatctgaaaatcaccagtccgacag tcgaggacacggccacctatttctgtgccagaggaggtgcttatgctact cttaacttgtggggcccgggcaccctcgtcaccgtctcgagc.
```

In another embodiment of the invention, polynucleotides of the invention comprise, or alternatively consist of, the following polynucleotide sequence encoding the constant heavy chain polypeptide sequence of SEQ ID NO: 90:

```
                                         (SEQ ID NO: 100)
gcctccaccaagggcccatcggtcttccccctggcaccctcctccaagag cacctctggggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.
```

In another embodiment of the invention, polynucleotides of the invention comprise, or alternatively consist of, the following polynucleotide sequence encoding the light chain polypeptide sequence of SEQ ID NO: 101:

```
                                         (SEQ ID NO: 111)
gccgtgctgacccagacaccatcacccgtgtctgcagctgtgggaggcac agtcaccatcagttgccagtccagtcagagtgtttatcataacaacctct tatcctggtatcagcagaaaccaggtcagcctcccaagctcttgatctac
```

-continued
```
gatgcatccaaactgacatctggggtctcatcgcggttcagcggcagtgg atctgggacacagttcactctcaccataagcggcgtgcagtgtgacgatg ctgccacttactactgtctaggcggttatgatgatgatgctgataatggt ttcggcggagggaccgaggtggtggtcaaacgtacggtagcggccccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.
```

In another embodiment of the invention, polynucleotides of the invention comprise, or alternatively consist of, the following polynucleotide sequence encoding the variable light chain polypeptide sequence of SEQ ID NO: 102:

```
                                        (SEQ ID NO: 112)
gccgtgctgacccagacaccatcaccgtgtctgcagctgtgggaggcac agtcaccatcagttgccagtccagtcagagtgtttatcataacaacctct tatcctggtatcagcagaaaccaggtcagcctcccaagctcttgatctac gatgcatccaaactgacatctggggtctcatcgcggttcagcggcagtgg atctgggacacagttcactctcaccataagcggcgtgcagtgtgacgatg ctgccacttactactgtctaggcggttatgatgatgatgctgataatggt ttcggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 110:

```
                                        (SEQ ID NO: 120)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 94; SEQ ID NO: 96; and SEQ ID NO: 98, which correspond to polynucleotides encoding the complementarity-determining regions (CDRs, or hypervariable regions) of the heavy chain sequence of SEQ ID NO: 81 or the variable heavy chain sequence of SEQ ID NO: 82, and/or one or more of the polynucleotide sequences of SEQ ID NO: 114; SEQ ID NO: 116; and SEQ ID NO: 118, which correspond to the complementarity-determining regions (CDRs, or hypervariable regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 93; SEQ ID NO: 95; SEQ ID NO: 97; and SEQ ID NO: 99, which correspond to polynucleotides encoding the framework regions (FRs or constant regions) of the heavy chain sequence of SEQ ID NO: 81 or the variable heavy chain sequence of SEQ ID NO: 82, and/or one or more of the polynucleotide sequences of SEQ ID NO: 113; SEQ ID NO: 115; SEQ ID NO: 117; and SEQ ID NO: 119, which correspond to the framework regions (FRs or constant regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 91 encoding the heavy chain sequence of SEQ ID NO: 81; the polynucleotide SEQ ID NO: 92 encoding the variable heavy chain sequence of SEQ ID NO: 82; the polynucleotide SEQ ID NO: 111 encoding the light chain sequence of SEQ ID NO: 101; the polynucleotide SEQ ID NO: 112 encoding the variable light chain sequence of SEQ ID NO: 102; polynucleotides encoding the complementarity-determining regions (SEQ ID NO: 94; SEQ ID NO: 96; and SEQ ID NO: 98) of the heavy chain sequence of SEQ ID NO: 81 or the variable heavy chain sequence of SEQ ID NO: 82; polynucleotides encoding the complementarity-determining regions (SEQ ID NO: 114; SEQ ID NO: 116; and SEQ ID NO: 118) of the light chain sequence of SEQ ID NO: 101 or the variable light chain sequence of SEQ ID NO: 102; polynucleotides encoding the framework regions (SEQ ID NO: 93; SEQ ID NO: 95; SEQ ID NO: 97; and SEQ ID NO: 99) of the heavy chain sequence of SEQ ID NO: 81 or the variable heavy chain sequence of SEQ ID NO: 82; and polynucleotides encoding the framework regions (SEQ ID NO: 113; SEQ ID NO: 115; SEQ ID NO: 117; and SEQ ID NO: 119) of the light chain sequence of SEQ ID NO: 101 or the variable light chain sequence of SEQ ID NO: 102.

In a preferred embodiment of the invention, polynucleotides of the invention comprise, or alternatively consist of, polynucleotides encoding Fab (fragment antigen binding) fragments having binding specificity for PCSK9. With respect to antibody Ab3, the polynucleotides encoding the full length Ab3 antibody comprise, or alternatively consist of, the polynucleotide SEQ ID NO: 91 encoding the heavy chain sequence of SEQ ID NO: 81 and the polynucleotide SEQ ID NO: 111 encoding the light chain sequence of SEQ ID NO: 101.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab3 following expression of the full-length polynucleotides in a suitable host. In another embodiment of the invention, anti-PCSK9 antibodies such as Ab3 or Fab fragments thereof may be produced via expression of Ab3 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab4

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 121:

(SEQ ID NO: 131)
cagtcggtggaggagtccgggggtcgcctggtcacgcctgggacacccct gacactcacctgcacagtctctggaatcgacctcagtagctatgcaatga tctgggtccgtcaggctccagaaaaggggctggaatacatcggatatatt ggtggtattgatagcacatactacgcgagctgggcgaaaggccgattcac catctccaaaacctcgaccacggtggatctgaaaatgaccagtccgacaa ccgaggacacggccacctatttctgtggcagatggtccggtactagtggt tataataccatctgggcccgggcaccctcgtcaccgtctcgagcgcctc caccaagggcccatcggtcttcccctggcaccctcctccaagagcacct ctggggcacagcggccctgggctgcctggtcaaggactacttccccgaa ccggtgacggtgtcgtggaactcaggcgccctgaccagcggcgtgcacac cttcccggctgtcctacagtcctcaggactctactccctcagcagcgtgg tgaccgtgccctccagcagcttgggcacccagacctacatctgcaacgtg aatcacaagcccagcaacaccaaggtggacaagagagttgagcccaaatc ttgtgacaaaactcacacatgcccaccgtgcccagcacctgaactcctgg ggggaccgtcagtcttcctcttccccccaaaacccaaggacaccctcatg atctcccggacccctgaggtcacatgcgtggtggtggacgtgagccacga agaccctgaggtcaagttcaactggtacgtggacggcgtggaggtgcata atgccaagacaaagccgcgggaggagcagtacgccagcacgtaccgtgtg gtcagcgtcctcaccgtcctgcaccaggactggctgaatggcaaggagta caagtgcaaggtctccaacaaagccctcccagcccccatcgagaaaacca tctccaaagccaaagggcagccccgagaaccacaggtgtacaccctgccc ccatcccgggaggagatgaccaagaaccaggtcagcctgacctgcctggt caaaggcttctatcccagcgacatcgccgtggagtgggagagcaatgggc -continued
agccggagaacaactacaagaccacgcctcccgtgctggactccgacggc tccttcttcctctacagcaagctcaccgtggacaagagcaggtggcagca ggggaacgtcttctcatgctccgtgatgcatgaggctctgcacaaccact acacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 122:

(SEQ ID NO: 132)
cagtcggtggaggagtccgggggtcgcctggtcacgcctgggacacccct gacactcacctgcacagtctctggaatcgacctcagtagctatgcaatga tctgggtccgtcaggctccagaaaaggggctggaatacatcggatatatt ggtggtattgatagcacatactacgcgagctgggcgaaaggccgattcac catctccaaaacctcgaccacggtggatctgaaaatgaccagtccgacaa ccgaggacacggccacctatttctgtggcagatggtccggtactagtggt tataataccatctgggcccgggcaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 130:

(SEQ ID NO: 140)
gcctccaccaagggcccatcggtcttcccctggcaccctcctccaagag cacctctggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 141:

```
                                           (SEQ ID NO: 151)
gatgttgtgatgacccagactccagcctccgtggaggcagctgtgggagg cacagtcaccatcaagtgccaggccagtcagagcatttatagcaatttag cctggtatcagcagaaaccagggcagcctcccaagctcctgatctatggt gcatccaatctggcatctggggtctcatcgcggttcaaaggcagtcgatc tgggacagagtacactctcaccatcagtgacctggagtgtgccgatgctg ccacctactactgtcagtgcactggtggtggtgatagcggtaatactttc ggcggagggaccgaggtggtggtcaaacgtacggtagcggcccatctgt cttcatcttcccgccatctgatgagcagttgaaatctggaactgcctctg ttgtgtgcctgctgaataacttctatcccagagaggccaaagtacagtgg aaggtggataacgccctccaatcgggtaactcccaggagagtgtcacaga gcaggacagcaaggacagcacctacagcctcagcagcaccctgacgctga gcaaagcagactacgagaaacacaaagtctacgcctgcgaagtcacccat cagggcctgagctcgcccgtcacaaagagcttcaacaggggagagtgt.
```

In another embodiment of the invention, polynucleotides of the invention comprise, or alternatively consist of, the following polynucleotide sequence encoding the variable light chain polypeptide sequence of SEQ ID NO: 142:

```
                                           (SEQ ID NO: 152)
gatgttgtgatgacccagactccagcctccgtggaggcagctgtgggagg cacagtcaccatcaagtgccaggccagtcagagcatttatagcaatttag cctggtatcagcagaaaccagggcagcctcccaagctcctgatctatggt gcatccaatctggcatctggggtctcatcgcggttcaaaggcagtcgatc tgggacagagtacactctcaccatcagtgacctggagtgtgccgatgctg ccacctactactgtcagtgcactggtggtggtgatagcggtaatactttc ggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 150:

```
                                           (SEQ ID NO: 160)
cgtacggtagcggcccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 134; SEQ ID NO: 136; and SEQ ID NO: 138, which correspond to polynucleotides encoding the complementarity-determining regions (CDRs, or hypervariable regions) of the heavy chain sequence of SEQ ID NO: 121 or the variable heavy chain sequence of SEQ ID NO: 122, and/or one or more of the polynucleotide sequences of SEQ ID NO: 154; SEQ ID NO: 156; and SEQ ID NO: 158, which correspond to the complementarity-determining regions (CDRs, or hypervariable regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 133; SEQ ID NO: 135; SEQ ID NO: 137; and SEQ ID NO: 139, which correspond to polynucleotides encoding the framework regions (FRs or constant regions) of the heavy chain sequence of SEQ ID NO: 121 or the variable heavy chain sequence of SEQ ID NO: 122, and/or one or more of the polynucleotide sequences of SEQ ID NO: 153; SEQ ID NO: 155; SEQ ID NO: 157; and SEQ ID NO: 159, which correspond to the framework regions (FRs or constant regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 131 encoding the heavy chain sequence of SEQ ID NO: 121; the polynucleotide SEQ ID NO: 132 encoding the variable heavy chain sequence of SEQ ID NO: 122; the polynucleotide SEQ ID NO: 151 encoding the light chain sequence of SEQ ID NO: 141; the polynucleotide SEQ ID NO: 152 encoding the variable light chain sequence of SEQ ID NO: 142; polynucleotides encoding the complementarity-determining regions (SEQ ID NO: 134; SEQ ID NO: 136; and SEQ ID NO: 138) of the heavy chain sequence of SEQ ID NO: 121 or the variable heavy chain sequence of SEQ ID NO: 122; polynucleotides encoding the complementarity-determining regions (SEQ ID NO: 154; SEQ ID NO: 156; and SEQ ID NO: 158) of the light chain sequence of SEQ ID NO: 141 or the variable light chain sequence of SEQ ID NO: 142; polynucleotides encoding the framework regions (SEQ ID NO: 133; SEQ ID NO: 135; SEQ ID NO: 137; and SEQ ID NO: 139) of the heavy chain sequence of SEQ ID NO: 121 or the variable heavy chain sequence of SEQ ID NO: 122; and polynucleotides encoding the framework regions (SEQ ID NO: 153; SEQ ID NO: 155; SEQ ID NO: 157; and SEQ ID NO: 159) of the light chain sequence of SEQ ID NO: 141 or the variable light chain sequence of SEQ ID NO: 142.

In a preferred embodiment of the invention, polynucleotides of the invention comprise, or alternatively consist of, polynucleotides encoding Fab (fragment antigen binding) fragments having binding specificity for PCSK9. With respect to antibody Ab4, the polynucleotides encoding the full length Ab4 antibody comprise, or alternatively consist of, the polynucleotide SEQ ID NO: 131 encoding the heavy chain sequence of SEQ ID NO: 121 and the polynucleotide SEQ ID NO: 151 encoding the light chain sequence of SEQ ID NO: 141.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab4 following expression of the full-length polynucleotides in a suitable host. In another embodiment of the invention, anti-PCSK9 antibodies such as Ab4 or Fab fragments thereof may be produced via expression of Ab4 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab5

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 161:

(SEQ ID NO: 171)
cagtcggtggaggagtccgggggtcgcctggtcacgcctgggacacccct gacactcacctgcacagtctctggattctccctcagtagctatgcaatga gctgggtccgccaggctccagggaagggctggaatggatcggaatcatt agtaatagtggtaccacatactacgcgagctgggcgaaaggccgattcac catctccaaaacctcgaccacggtggatctgaaaatcaccagtccgacaa ccgaggacacggccacctatttctgtgccagaggaatatattggtactgg agagttttttaacttgtggggcccggggaccctcgtcaccgtctcgagcgc ctccaccaagggcccatcggtcttcccctggcaccctcctccaagagca cctctgggggcacagcggccctgggctgcctggtcaaggactacttcccc gaaccggtgacggtgtcgtggaactcaggcgccctgaccagcggcgtgca caccttcccggctgtcctacagtcctcaggactctactccctcagcagcg tggtgaccgtgccctccagcagcttgggcacccagacctacatctgcaac gtgaatcacaagcccagcaacaccaaggtggacaagagagttgagcccaa atcttgtgacaaaactcacacatgcccaccgtgcccagcacctgaactcc tgggggaccgtcagtcttcctcttccccccaaaacccaaggacaccctc atgatctcccggacccctgaggtcacatgcgtggtggtggacgtgagcca cgaagaccctgaggtcaagttcaactggtacgtggacggcgtggaggtgc ataatgccaagacaaagccgcgggaggagcagtacgccagcacgtaccgt -continued
gtggtcagcgtcctcaccgtcctgcaccaggactggctgaatggcaagga gtacaagtgcaaggtctccaacaaagccctcccagcccccatcgagaaaa ccatctccaaagccaaagggcagccccgagaaccacaggtgtacaccctg cccccatcccgggaggagatgaccaagaaccaggtcagcctgacctgcct ggtcaaaggcttctatcccagcgacatcgccgtggagtgggagagcaatg ggcagccggagaacaactacaagaccacgcctcccgtgctggactccgac ggctccttcttcctctacagcaagctcaccgtggacaagagcaggtggca gcaggggaacgtcttctcatgctccgtgatgcatgaggctctgcacaacc actacacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 162:

(SEQ ID NO: 172)
cagtcggtggaggagtccgggggtcgcctggtcacgcctgggacacccc tgacactcacctgcacagtctctggattctccctcagtagctatgcaat gagctgggtccgccaggctccagggaagggctggaatggatcggaatc attagtaatagtggtaccacatactacgcgagctgggcgaaaggccgat tcaccatctccaaaacctcgaccacggtggatctgaaaatcaccagtcc gacaaccgaggacacggccacctatttctgtgccagaggaatatattgg tactggagagttttaacttgtggggcccggggaccctcgtcaccgtc tcgagc.

In another embodiment of the invention, polynucleotides of the invention comprise, or alternatively consist of, the following polynucleotide sequence encoding the constant heavy chain polypeptide sequence of SEQ ID NO: 170:

(SEQ ID NO: 180)
gcctccaccaagggcccatcggtcttcccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctgggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag -continued
```
gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.
```

In another embodiment of the invention, polynucleotides of the invention comprise, or alternatively consist of, the following polynucleotide sequence encoding the light chain polypeptide sequence of SEQ ID NO: 181:

```
                                      (SEQ ID NO: 191)
gccgtgctgacccagacaccatcgcctgtgtctgcagctgtgggaggca cagtcaccatcaattgccaggccagtcagagtgtttataacaacctctt atcctggtatcagcagaaaccagggcagcctcccaagctcctgatctat gatgcatccaatctggcatctggggtcccagataggttcagcggcagtg gatctgggacacagttcactctcaccatcagcggcgtgcagtgtgacga tgctgccacttactactgtctaggcggttatgatgatgatgctgataat gctttcggcggagggaccgaggtggtggtcaaacgtacggtagcggccc catctgtcttcatcttcccgccatctgatgagcagttgaaatctggaac tgcctctgttgtgtgcctgctgaataacttctatcccagagagg ccaaagtacagtggaaggtggataacgccctccaatcgggtaactccca ggagagtgtcacagagcaggacagcaaggacagcacctacagcctcagc agcacctgacgctgagcaaagcagactacgagaaacacaaagtctacg cctgcgaagtcacccatcagggcctgagctcgcccgtcacaaagagctt caacaggggagagtgt.
```

In another embodiment of the invention, polynucleotides of the invention comprise, or alternatively consist of, the following polynucleotide sequence encoding the variable light chain polypeptide sequence of SEQ ID NO: 182:

```
                                      (SEQ ID NO: 192)
gccgtgctgacccagacaccatcgcctgtgtctgcagctgtgggaggca cagtcaccatcaattgccaggccagtcagagtgtttataacaacctctt atcctggtatcagcagaaaccagggcagcctcccaagctcctgatctat gatgcatccaatctggcatctggggtcccagataggttcagcggcagtg gatctgggacacagttcactctcaccatcagcggcgtgcagtgtgacga tgctgccacttactactgtctaggcggttatgatgatgatgctgataat gctttcggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 190:

```
                                      (SEQ ID NO: 200)
cgtacggtagcggcccatctgtcttcatcttcccgccatctgatgagc agttgaaatctggaactgcctctgttgtgtgcctgctgaataacttcta
```

-continued
```
tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 174; SEQ ID NO: 176; and SEQ ID NO: 178, which correspond to polynucleotides encoding the complementarity-determining regions (CDRs, or hypervariable regions) of the heavy chain sequence of SEQ ID NO: 161 or the variable heavy chain sequence of SEQ ID NO: 162, and/or one or more of the polynucleotide sequences of SEQ ID NO: 194; SEQ ID NO: 196; and SEQ ID NO: 198, which correspond to the complementarity-determining regions (CDRs, or hypervariable regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 173; SEQ ID NO: 175; SEQ ID NO: 177; and SEQ ID NO: 179, which correspond to polynucleotides encoding the framework regions (FRs or constant regions) of the heavy chain sequence of SEQ ID NO: 161 or the variable heavy chain sequence of SEQ ID NO: 162, and/or one or more of the polynucleotide sequences of SEQ ID NO: 193; SEQ ID NO: 195; SEQ ID NO: 197; and SEQ ID NO: 199, which correspond to the framework regions (FRs or constant regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 171 encoding the heavy chain sequence of SEQ ID NO: 161; the polynucleotide SEQ ID NO: 172 encoding the variable heavy chain sequence of SEQ ID NO: 162; the polynucleotide SEQ ID NO: 191 encoding the light chain sequence of SEQ ID NO: 181; the polynucleotide SEQ ID NO: 192 encoding the variable light chain sequence of SEQ ID NO: 182; polynucleotides encoding the complementarity-determining regions (SEQ ID NO: 174; SEQ ID NO: 176; and SEQ ID NO: 178) of the heavy chain sequence of SEQ ID NO: 161 or the variable heavy chain sequence of SEQ ID NO: 162; polynucleotides encoding the complementarity-determining regions (SEQ ID NO: 194; SEQ ID NO: 196; and SEQ ID NO: 198) of the light chain sequence of SEQ ID NO: 181 or the variable light chain sequence of SEQ ID NO: 182; polynucleotides encoding the framework regions (SEQ ID NO: 173; SEQ ID NO: 175; SEQ ID NO: 177; and SEQ ID NO: 179) of the heavy chain sequence of SEQ ID NO: 161 or the variable heavy chain sequence of SEQ ID NO: 162; and polynucleotides encoding the framework regions (SEQ ID NO: 193; SEQ ID NO: 195; SEQ ID NO: 197; and SEQ ID NO: 199) of the light chain sequence of SEQ ID NO: 181 or the variable light chain sequence of SEQ ID NO: 182.

In a preferred embodiment of the invention, polynucleotides of the invention comprise, or alternatively consist of, polynucleotides encoding Fab (fragment antigen binding) fragments having binding specificity for PCSK9. With respect to antibody Ab5, the polynucleotides encoding the full length Ab5 antibody comprise, or alternatively consist of, the polynucleotide SEQ ID NO: 171 encoding the heavy chain sequence of SEQ ID NO: 161 and the polynucleotide SEQ ID NO: 191 encoding the light chain sequence of SEQ ID NO: 181.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab5 following expression of the full-length polynucleotides in a suitable host. In another embodiment of the invention, anti-PCSK9 antibodies such as Ab5 or Fab fragments thereof may be produced via expression of Ab5 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab6

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 201:

(SEQ ID NO: 211)
caggagcagctggaggagtccggggagacctggtcaagcctgagggatc cctgacactcacctgcacagcctctggattctccttcagtagcaactact ggatatgctgggtccgccaggctccagggaagggactggagtggatcgga tgcattcgtgatggtggtggcacttactacgcgagctgggcgaaaggccg actcaccatctccatgacctcgtcgaccacggtgactctgcaactgaaca gtctgacagccgcggacacggccacctattttttgtgcgagcgatattaat gatgggtggcttggccaattcaacttgtggggcccaggcaccctcgtcac cgtctcgagcgcctccaccaagggcccatcggtcttcccctggcaccct cctccaagagcacctctgggggcacagcggccctgggctgcctggtcaag gactacttccccgaaccggtgacggtgtcgtggaactcaggcgccctgac cagcggcgtgcacaccttcccggctgtcctacagtcctcaggactctact -continued
ccctcagcagcgtggtgaccgtgccctccagcagcttgggcacccagacc tacatctgcaacgtgaatcacaagcccagcaacaccaaggtggacaagag agttgagcccaaatcttgtgacaaaactcacacatgcccaccgtgcccag cacctgaactcctgggggaccgtcagtcttcctcttccccccaaaaccc aaggacaccctcatgatctcccggacccctgaggtcacatgcgtggtggt ggacgtgagccacgaagaccctgaggtcaagttcaactggtacgtggacg gcgtggaggtgcataatgccaagacaaagccgcgggaggagcagtacgcc agcacgtaccgtgtggtcagcgtcctcaccgtcctgcaccaggactggct gaatggcaaggagtacaagtgcaaggtctccaacaaagccctcccagccc ccatcgagaaaaccatctccaaagccaaagggcagccccgagaaccacag gtgtacaccctgccccccatcccgggaggagatgaccaagaaccaggtcag cctgacctgcctggtcaaaggcttctatcccagcgacatcgccgtggagt gggagagcaatgggcagccggagaacaactacaagaccacgcctcccgtg ctggactccgacggctccttcttcctctacagcaagctcaccgtggacaa gagcaggtggcagcaggggaacgtcttctcatgctccgtgatgcatgagg ctctgcacaaccactacacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 202:

(SEQ ID NO: 212)
caggagcagctggaggagtccggggagacctggtcaagcctgagggat ccctgacactcacctgcacagcctctggattctccttcagtagcaacta ctggatatgctgggtccgccaggctccagggaagggactggagtggatc ggatgcattcgtgatggtggtggcacttactacgcgagctgggcgaaag gccgactcaccatctccatgacctcgtcgaccacggtgactctgcaact gaacagtctgacagccgcggacacggccacctattttttgtgcgagcgat attaatgatgggtggcttggccaattcaacttgtggggcccaggcacc ctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 210:

(SEQ ID NO: 220)
gcctccaccaagggcccatcggtcttcccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctgggggaccgtcagtcttcctcttccccccaaacccaa -continued
ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccg tgatgcatgaggctctgcacaaccactacacgcagaagagcctctccct gtctccgggtaaa.

In another embodiment of the invention, polynucleotides of the invention comprise, or alternatively consist of, the following polynucleotide sequence encoding the light chain polypeptide sequence of SEQ ID NO: 221:

(SEQ ID NO: 231)
gctgacattgtgatgacccagactccagcctctgtggaggtagctgtgg gaggcacagtcaccatcaagtgccaggccagtcagagcattagtgcgta cttagcctggtatcagcagaaaccagggcagcctcccaagctcctgatc tacagggcatacactctggcatctggggtcccatcgcggttcaaaggca gtggatctgggacacagttcactctcaccatcagcgacctggagtgtgc cgatgctgccacttactactgtcaaagctattattccgttactactaat acttatggaaatactttcggcggagggaccgaggtggtggtcaaacgta cggtagcggcccatctgtcttcatcttcccgccatctgatgagcagtt gaaatctggaactgcctctgttgtgtgcctgctgaataacttctatccc agagaggccaaagtacagtggaaggtggataacgccctccaatcgggta actcccaggagagtgtcacagagcaggacagcaaggacagcacctacag cctcagcagcaccctgacgctgagcaaagcagactacgagaaacacaaa gtctacgcctgcgaagtcacccatcagggcctgagctcgcccgtcacaa agagcttcaacaggggagagtgt.

In another embodiment of the invention, polynucleotides of the invention comprise, or alternatively consist of, the following polynucleotide sequence encoding the variable light chain polypeptide sequence of SEQ ID NO: 222:

(SEQ ID NO: 232)
gctgacattgtgatgacccagactccagcctctgtggaggtagctgtgg gaggcacagtcaccatcaagtgccaggccagtcagagcattagtgcgta cttagcctggtatcagcagaaaccagggcagcctcccaagctcctgatc tacagggcatacactctggcatctggggtcccatcgcggttcaaaggca gtggatctgggacacagttcactctcaccatcagcgacctggagtgtgc cgatgctgccacttactactgtcaaagctattattccgttactactaat acttatggaaatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 230:

(SEQ ID NO: 240)
cgtacggtagcggcccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 214; SEQ ID NO: 216; and SEQ ID NO: 218, which correspond to polynucleotides encoding the complementarity-determining regions (CDRs, or hypervariable regions) of the heavy chain sequence of SEQ ID NO: 201 or the variable heavy chain sequence of SEQ ID NO: 202, and/or one or more of the polynucleotide sequences of SEQ ID NO: 234; SEQ ID NO: 236; and SEQ ID NO: 238, which correspond to the complementarity-determining regions (CDRs, or hypervariable regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 213; SEQ ID NO: 215; SEQ ID NO: 217; and SEQ ID NO: 219, which correspond to polynucleotides encoding the framework regions (FRs or constant regions) of the heavy chain sequence of SEQ ID NO: 201 or the variable heavy chain sequence of SEQ ID NO: 202, and/or one or more of the polynucleotide sequences of SEQ ID NO: 233; SEQ ID NO: 235; SEQ ID NO: 237; and SEQ ID NO: 239, which correspond to the framework regions (FRs or constant regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 211 encoding the heavy chain sequence of SEQ ID NO: 201; the polynucleotide SEQ ID NO: 212 encoding the variable heavy chain sequence of SEQ ID NO: 202; the polynucleotide SEQ ID NO: 231 encoding the light chain sequence of SEQ ID NO: 221; the polynucleotide SEQ ID NO: 232 encoding the variable light chain sequence of SEQ ID NO: 222; polynucleotides encoding the complementarity-determining regions (SEQ ID NO: 214; SEQ ID NO: 216; and SEQ ID NO: 218) of the heavy chain sequence of SEQ ID NO: 201 or the variable heavy chain sequence of SEQ ID NO: 202; polynucleotides encoding the complementarity-determining regions (SEQ ID NO: 234; SEQ ID NO: 236; and SEQ ID NO: 238) of the light chain sequence of SEQ ID NO: 221 or the variable light chain sequence of SEQ ID NO: 222; polynucleotides encoding the framework regions (SEQ ID NO: 213; SEQ ID NO: 215; SEQ ID NO: 217; and SEQ ID NO: 219) of the heavy chain sequence of SEQ ID NO: 201 or the variable heavy chain sequence of SEQ ID NO: 202; and polynucleotides encoding the framework regions (SEQ ID NO: 233; SEQ ID NO: 235; SEQ ID NO: 237; and SEQ ID NO: 239) of the light chain sequence of SEQ ID NO: 221 or the variable light chain sequence of SEQ ID NO: 222.

In a preferred embodiment of the invention, polynucleotides of the invention comprise, or alternatively consist of, polynucleotides encoding Fab (fragment antigen binding) fragments having binding specificity for PCSK9. With respect to antibody Ab6, the polynucleotides encoding the full length Ab6 antibody comprise, or alternatively consist of, the polynucleotide SEQ ID NO: 211 encoding the heavy chain sequence of SEQ ID NO: 201 and the polynucleotide SEQ ID NO: 231 encoding the light chain sequence of SEQ ID NO: 221.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab6 following expression of the full-length polynucleotides in a suitable host. In another embodiment of the invention, anti-PCSK9 antibodies such as Ab6 or Fab fragments thereof may be produced via expression of Ab6 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab7

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 241:

(SEQ ID NO: 251)
gaggtgcagcttgtggagtctgggggaggcttggtccagcctgggggt ccctgagactctcctgtgcagcctctggattcaccgtcagtagcaacta ctggatatgctgggtccgtcaggctccagggaaggggctggagtggatc ggatgcattcgtgatggtggtggcacttactacgctagctctgctaaag gccgattcaccatctccagagacaattccaagaacaccctgtatcttca aatgaacagcctgagagctgaggacactgctgtgtattactgtgctagc gatatcaatgatgggtggcttggccaattcaacttgtggggccaaggga ccctcgtcaccgtctcgagcgcctccaccaagggcccatcggtcttccc cctggcaccctcctccaagagcacctctgggggcacagcggccctgggc tgcctggtcaaggactacttccccgaaccggtgacggtgtcgtggaact caggcgccctgaccagcggcgtgcacaccttcccggctgtcctacagtc ctcaggactctactccctcagcagcgtggtgaccgtgccctccagcagc ttgggcacccagacctacatctgcaacgtgaatcacaagcccagcaaca ccaaggtggacaagagagttgagcccaaatcttgtgacaaaactcacac atgcccaccgtgcccagcacctgaactcctgggggaccgtcagtcttc acgtcttctcatgctccgtgatgcatgaggctctgcacaaccactacac ctcttccccccaaaacccaaggacaccctcatgatctcccgacccctg aggtcacatgcgtggtggtggacgtgagccacgaagaccctgaggtcaa gttcaactggtacgtggacggcgtggaggtgcataatgccaagacaaag ccgcgggaggagcagtacgccagcacgtaccgtgtggtcagcgtcctca ccgtcctgcaccaggactggctgaatggcaaggagtacaagtgcaaggt ctccaacaaagccctcccagccccatcgagaaaaccatctccaaagcc aaagggcagccccgagaaccacaggtgtacaccctgcccccatcccggg aggagatgaccaagaaccaggtcagcctgacctgcctggtcaaaggctt ctatcccagcgacatcgccgtggagtgggagagcaatgggcagccggag aacaactacaagaccacgcctcccgtgctggactccgacggctccttct tcctctacagcaagctcaccgtggacaagagcaggtggcagcaggggag cagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 242:

(SEQ ID NO: 252)
gaggtgcagcttgtggagtctgggggaggcttggtccagcctgggggt ccctgagactctcctgtgcagcctctggattcaccgtcagtagcaacta ctggatatgctgggtccgtcaggctccagggaaggggctggagtggatc ggatgcattcgtgatggtggtggcacttactacgctagctctgctaaag gccgattcaccatctccagagacaattccaagaacaccctgtatcttca aatgaacagcctgagagctgaggacactgctgtgtattactgtgctagc gatatcaatgatgggtggcttggccaattcaacttgtggggccaaggga ccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 250:

(SEQ ID NO: 260)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctgggggaccgtcagtcttcctcttcccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 261:

(SEQ ID NO: 271)
gctgacattgtgatgacccagtctccatcctccctgtctgcatctgtagg agacagagtcaccatcaagtgccaggccagtcagagcattagtgcttact tagcctggtatcagcagaaaccagggaaagtccctaagctcctgatctat agggcatacactctggcatctggggtcccatctcgtttcagtggcagtgg atctgggacagatttcactctcaccatcagcagcctgcagcctgaagatg ttgcaacttattactgtcaaagctactattccgttactactaatacttat ggaaatactttcggcggaggaaccaaggtggaaatcaaacgtacggtggc tgcaccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 262:

(SEQ ID NO: 271)
gctgacattgtgatgacccagtctccatcctccctgtctgcatctgtagg agacagagtcaccatcaagtgccaggccagtcagagcattagtgcttact tagcctggtatcagcagaaaccagggaaagtccctaagctcctgatctat agggcatacactctggcatctggggtcccatctcgtttcagtggcagtgg atctgggacagatttcactctcaccatcagcagcctgcagcctgaagatg ttgcaacttattactgtcaaagctactattccgttactactaatacttat ggaaatactttcggcggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 270:

(SEQ ID NO: 280)
cgtacggtggctgcaccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 254; SEQ ID NO: 256; and SEQ ID NO: 258, which correspond to polynucleotides encoding the complementarity-determining regions (CDRs, or hypervariable regions) of the heavy chain sequence of SEQ ID NO: 241 or the variable heavy chain sequence of SEQ ID NO: 242, and/or one or more of the polynucleotide sequences of SEQ ID NO: 274; SEQ ID NO: 276; and SEQ ID NO: 278, which correspond to the complementarity-determining regions (CDRs, or hypervariable regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 253; SEQ ID NO: 255; SEQ ID NO: 257; and SEQ ID NO: 259, which correspond to polynucleotides encoding the framework regions (FRs or constant regions) of the heavy chain sequence of SEQ ID NO: 241 or the variable heavy chain sequence of SEQ ID NO: 242, and/or one or more of the polynucleotide sequences of SEQ ID NO: 273; SEQ ID NO: 275; SEQ ID NO: 277; and SEQ ID NO: 279, which correspond to the framework regions (FRs or constant regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 251 encoding the heavy chain sequence of SEQ ID NO: 241; the polynucleotide SEQ ID NO: 252 encoding the variable heavy chain sequence of SEQ ID NO: 242; the polynucleotide SEQ ID NO: 271 encoding the light chain sequence of SEQ ID NO: 261; the polynucleotide SEQ ID NO: 272 encoding the variable light chain sequence of SEQ ID NO: 262; polynucleotides encoding the complementarity-determining regions (SEQ ID NO: 254; SEQ ID NO: 256; and SEQ ID NO: 258) of the heavy chain sequence of SEQ ID NO: 241 or the variable heavy chain sequence of SEQ ID NO: 242; polynucleotides encoding the complementarity-determining regions (SEQ ID NO: 274; SEQ ID NO: 276; and SEQ ID NO: 278) of the light chain sequence of SEQ ID NO: 261 or the variable light chain sequence of SEQ ID NO: 262; polynucleotides encoding the framework regions (SEQ ID NO: 253; SEQ ID NO: 255; SEQ ID NO: 257; and SEQ ID NO: 259) of the heavy chain sequence of SEQ ID NO: 241 or the variable heavy chain sequence of SEQ ID NO: 242; and polynucleotides encoding the framework regions (SEQ ID NO: 273; SEQ ID NO: 275; SEQ ID NO: 277; and SEQ ID NO: 279) of the light chain sequence of SEQ ID NO: 261 or the variable light chain sequence of SEQ ID NO: 262.

In a preferred embodiment of the invention, polynucleotides of the invention comprise, or alternatively consist of, polynucleotides encoding Fab (fragment antigen binding) fragments having binding specificity for PCSK9. With respect to antibody Ab7, the polynucleotides encoding the full length Ab7 antibody comprise, or alternatively consist of, the polynucleotide SEQ ID NO: 251 encoding the heavy chain sequence of SEQ ID NO: 241 and the polynucleotide SEQ ID NO: 271 encoding the light chain sequence of SEQ ID NO: 261.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab7 following expression of the full-length polynucleotides in a suitable host. In another embodiment of the invention, anti-PCSK9 antibodies such as Ab7 or Fab fragments thereof may be produced via expression of Ab7 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab8

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 281:

```
                                          (SEQ ID NO: 291)
caggagcagctggtggagtccggggggaggcctggtccagcctgagggatc cctgacactcacctgcacagcttctggattctccttcactagcgactatt acatgtgctgggtccgccaggctccagggaaggggctggagtggatcgga tgcatttctactggtgatggcagcacatactacgcgagctgggcgaaagg ccgattcaccatctccaaaccctcgtcgaccacggtgactctgcaaatga ccaggctgacagccgcggacacggccacctatttctgtgcgagagatcga tactatagttatgcttatggtgcttatgtttatgctagcgacttgtgggg cccaggcaccctcgtcaccgtctcgagcgcctccaccaagggcccatcgg tcttccccctggcaccctcctccaagagcacctctgggggcacagcggcc ctgggctgcctggtcaaggactacttccccgaaccggtgacggtgtcgtg gaactcaggcgccctgaccagcggcgtgcacaccttcccggctgtcctac agtcctcaggactctactcctcagcagcgtggtgaccgtgccctccagc agcttgggcacccagacctacatctgcaacgtgaatcacaagcccagcaa caccaaggtggacaagagagttgagcccaaatcttgtgacaaaactcaca catgcccaccgtgcccagcacctgaactcctgggggaccgtcagtcttc ctcttccccccaaaacccaaggacaccctcatgatctcccggacccctga ggtcacatgcgtggtggtggacgtgagccacgaagaccctgaggtcaagt tcaactggtacgtggacggcgtggaggtgcataatgccaagacaaagccg cgggaggagcagtacgccagcacgtaccgtgtggtcagcgtcctcaccgt cctgcaccaggactggctgaatggcaaggagtacaagtgcaaggtctcca acaaagccctcccagcccccatcgagaaaaccatctccaaagccaaaggg cagccccgagaaccacaggtgtacaccctgcccccatcccgggaggagat gaccaagaaccaggtcagcctgacctgcctggtcaaaggcttctatccca gcgacatcgccgtggagtgggagagcaatgggcagccggagaacaactac aagaccacgcctcccgtgctggactccgacggctccttcttcctctacag caagctcaccgtggacaagagcaggtggcagcaggggaacgtcttctcat gctccgtgatgcatgaggctctgcacaaccactacacgcagaagagcctc tccctgtctccgggtaaa.
```

In another embodiment of the invention, the polynucleotides of the invention comprise, or alternatively consist of, the following polynucleotide sequence encoding the variable heavy chain polypeptide sequence of SEQ ID NO: 282:

```
                                          (SEQ ID NO: 292)
caggagcagctggtggagtccggggggaggcctggtccagcctgagggatc cctgacactcacctgcacagcttctggattctccttcactagcgactatt acatgtgctgggtccgccaggctccagggaaggggctggagtggatcgga tgcatttctactggtgatggcagcacatactacgcgagctgggcgaaagg ccgattcaccatctccaaaccctcgtcgaccacggtgactctgcaaatga ccaggctgacagccgcggacacggccacctatttctgtgcgagagatcga
```

In another embodiment of the invention, polynucleotides of the invention comprise, or alternatively consist of, the following polynucleotide sequence encoding the constant heavy chain polypeptide sequence of SEQ ID NO: 290:

(SEQ ID NO: 300)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 301:

(SEQ ID NO: 311)
gctgacattgtgatgacccagactccagcctccgtgtctgaacctgtggg aggcacagtcaccatcaattgccaggccagtgaaagcattaggaactact tatcctggtatcaacagaaaccagggcagcgtcccaagctcctgatctat ggtgcatccactctggcatctggggtcccatcgcggttcaaaggcagtgg atctgggacagatttcactctcaccatcagcgacctggagtgtgccgatg ctgccacttactactgtcaaagcaattatggtattagtagtcgtagttat gttaatggtttcggcggagggaccgaggtggtggtcaaacgtacggtagc ggccccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 302:

(SEQ ID NO: 312)
gctgacattgtgatgacccagactccagcctccgtgtctgaacctgtggg aggcacagtcaccatcaattgccaggccagtgaaagcattaggaactact tatcctggtatcaacagaaaccagggcagcgtcccaagctcctgatctat ggtgcatccactctggcatctggggtcccatcgcggttcaaaggcagtgg atctgggacagatttcactctcaccatcagcgacctggagtgtgccgatg ctgccacttactactgtcaaagcaattatggtattagtagtcgtagttat gttaatggtttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 310:

(SEQ ID NO: 320)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 294; SEQ ID NO: 296; and SEQ ID NO: 298, which correspond to polynucleotides encoding the complementarity-determining regions (CDRs, or hypervariable regions) of the heavy chain sequence of SEQ ID NO: 281 or the variable heavy chain sequence of SEQ ID NO: 282, and/or one or more of the polynucleotide sequences of SEQ ID NO: 314; SEQ ID NO: 316; and SEQ ID NO: 318, which correspond to the complementarity-determining regions (CDRs, or hypervariable regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 293; SEQ ID NO: 295; SEQ ID NO: 297; and SEQ ID NO: 299, which correspond to polynucleotides encoding the framework regions (FRs or constant regions) of the heavy chain sequence of SEQ ID NO: 281 or the variable heavy chain sequence of SEQ ID NO: 282, and/or one or more of the polynucleotide sequences of SEQ ID NO: 313; SEQ ID NO: 315; SEQ ID NO: 317; and SEQ ID NO: 319, which correspond to the framework regions (FRs or constant regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 291 encoding the heavy chain sequence of SEQ ID NO: 281; the polynucleotide SEQ ID NO: 292 encoding the variable heavy chain sequence of SEQ ID NO: 282; the polynucleotide SEQ ID NO: 311 encoding the light chain sequence of SEQ ID NO: 301; the polynucleotide SEQ ID NO: 312 encoding the variable light chain sequence of SEQ ID NO: 302; polynucleotides encoding the complementarity-determining regions (SEQ ID NO: 294; SEQ ID NO: 296; and SEQ ID NO: 298) of the heavy chain sequence of SEQ ID NO: 281 or the variable heavy chain sequence of SEQ ID NO: 282; polynucleotides encoding the complementarity-determining regions (SEQ ID NO: 314; SEQ ID NO: 316; and SEQ ID NO: 318) of the light chain sequence of SEQ ID NO: 301 or the variable light chain sequence of SEQ ID NO: 302; polynucleotides encoding the framework regions (SEQ ID NO: 293; SEQ ID NO: 295; SEQ ID NO: 297; and SEQ ID NO: 299) of the heavy chain sequence of SEQ ID NO: 281 or the variable heavy chain sequence of SEQ ID NO: 282; and polynucleotides encoding the framework regions (SEQ ID NO: 313; SEQ ID NO: 315; SEQ ID NO: 317; and SEQ ID NO: 319) of the light chain sequence of SEQ ID NO: 301 or the variable light chain sequence of SEQ ID NO: 302.

In a preferred embodiment of the invention, polynucleotides of the invention comprise, or alternatively consist of, polynucleotides encoding Fab (fragment antigen binding) fragments having binding specificity for PCSK9. With respect to antibody Ab8, the polynucleotides encoding the full length Ab8 antibody comprise, or alternatively consist of, the polynucleotide SEQ ID NO: 291 encoding the heavy chain sequence of SEQ ID NO: 281 and the polynucleotide SEQ ID NO: 311 encoding the light chain sequence of SEQ ID NO: 301.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab8 following expression of the full-length polynucleotides in a suitable host. In another embodiment of the invention, anti-PCSK9 antibodies such as Ab8 or Fab fragments thereof may be produced via expression of Ab8 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab9

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 321:

```
                                        (SEQ ID NO: 331)
cagtcggtggaggagtccggggtcgcctggtaacgcctgggacacccct gacactcacctgcacagtctctgaatcgacctcagtagctatgcaatgg gctgggtccgccaggctccagggaagggctggaatacatcggaatcatt gttagttatgggcccacatactacgcgagctgggcgaaaggccgattcac catctccaaaacctcgaccacggtggatctgaaaatcaccagtccgacgg ccgaggacacggccacctatttctgtgccagagatctggatgctaatagt agtggttattatggatgctttaacatctggggccaggggaccctcgtcac cgtctcgagcgcctccaccaagggcccatcggtcttcccctggcaccct cctccaagagcacctctgggggcacagcggccctgggctgcctggtcaag gactacttccccgaaccggtgacggtgtcgtggaactcaggcgccctgac cagcggcgtgcacaccttcccggctgtcctacagtcctcaggactctact ccctcagcagcgtggtgaccgtgccctccagcagcttgggcacccagacc tacatctgcaacgtgaatcacaagcccagcaacaccaaggtggacaagag agttgagcccaaatcttgtgacaaaactcacacatgcccaccgtgcccag cacctgaactcctgggggaccgtcagtcttcctcttccccccaaaaccc aaggacacctcatgatctcccggacccctgaggtcacatgcgtggtggtg gacgtgagccacgaagaccctgaggtcaagttcaactggtacgtggacggc gtggaggtgcataatgccaagacaaagccgcgggaggagcagtacgccagc acgtaccgtgtggtcagcgtcctcaccgtcctgcaccaggactggctgaat ggcaaggagtacaagtgcaaggtctccaacaaagccctcccagcccccatc gagaaaaccatctccaaagccaaagggcagccccgagaaccacaggtgtac accctgcccccatcccgggaggagatgaccaagaaccaggtcagcctgacc tgcctggtcaaaggcttctatcccagcgacatcgccgtggagtgggagagc aatgggcagccggagaacaactacaagaccacgcctcccgtgctggactcc gacggctccttcttcctctacagcaagctcaccgtggacaagagcaggtgg cagcaggggaacgtcttctcatgctccgtgatgcatgaggctctgcacaac cactacacgcagaagagcctctccctgtctccgggtaaa.
```

In another embodiment of the invention, the polynucleotides of the invention comprise, or alternatively consist of, the following polynucleotide sequence encoding the variable heavy chain polypeptide sequence of SEQ ID NO: 322:

(SEQ ID NO: 332)
cagtcggtggaggagtccgggggtcgcctggtaacgcctgggacacccct gacactcacctgcacagtctctggaatcgacctcagtagctatgcaatgg gctgggtccgccaggctccagggaaggggctggaatacatcggaatcatt gttagttatgggcccacatactacgcgagctgggcgaaaggccgattcac catctccaaaacctcgaccacggtggatctgaaaatcaccagtccgacgg ccgaggacacggccacctatttctgtgccagagatctggatgctaatagt agtggttattatggatgctttaacatctggggccaggggaccctcgtcac cgtctcgagc.

In another embodiment of the invention, polynucleotides of the invention comprise, or alternatively consist of, the following polynucleotide sequence encoding the constant heavy chain polypeptide sequence of SEQ ID NO: 330:

(SEQ ID NO: 340)
gcctccaccaagggcccatcggtcttccccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 341:

(SEQ ID NO: 351)
gccgtcgtgctgacccagactccagcctccgtgtctgcagctgtgggtgg cacagtcaccatcaagtgccaggccagtcagagcattagcactgcattag cctggtatcagcagaaaccagggcagcctcccaagctcctgatctatgct gcatcccctctggcatctggggtctcatcgcggttcaagagcagtggatc tgggacagagttcactctcaccatcagcgacctggagtgtgccgatgctg ccacttattactgtcaaagctattatggtagtagcaatattgctttcggc ggagggaccgagctggagatcctacgtacggtagcggccccatctgtctt catcttcccgccatctgatgagcagttgaaatctggaactgcctctgttg tgtgcctgctgaataacttctatcccagagaggccaaagtacagtggaag gtggataacgcctccaatcgggtaactcccaggagagtgtcacagagca ggacagcaaggacagcacctacagcctcagcagcaccctgacgctgagca aagcagactacgagaaacacaaagtctacgcctgcgaagtcacccatcag ggcctgagctcgcccgtcacaaagagcttcaacaggggagagtgt.

In another embodiment of the invention, polynucleotides of the invention comprise, or alternatively consist of, the following polynucleotide sequence encoding the variable light chain polypeptide sequence of SEQ ID NO: 342:

(SEQ ID NO: 352)
gccgtcgtgctgacccagactccagcctccgtgtctgcagctgtgggtgg cacagtcaccatcaagtgccaggccagtcagagcattagcactgcattag cctggtatcagcagaaaccagggcagcctcccaagctcctgatctatgct gcatcccctctggcatctggggtctcatcgcggttcaagagcagtggatc tgggacagagttcactctcaccatcagcgacctggagtgtgccgatgctg ccacttattactgtcaaagctattatggtagtagcaatattgctttcggc ggagggaccgagctggagatccta.

In another embodiment of the invention, polynucleotides of the invention comprise, or alternatively consist of, the following polynucleotide sequence encoding the constant light chain polypeptide sequence of SEQ ID NO: 350:

(SEQ ID NO: 360)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgcctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 334; SEQ ID NO: 336; and SEQ ID NO: 338, which correspond to polynucleotides encoding the complementarity-determining regions (CDRs, or hypervariable regions) of the heavy chain sequence of SEQ ID NO: 321 or the variable heavy chain sequence of SEQ ID NO: 322, and/or one or more of the polynucleotide sequences of SEQ ID NO: 354; SEQ ID NO: 356; and SEQ ID NO: 358, which correspond to the complementarity-determining regions (CDRs, or hypervariable regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 333; SEQ ID NO: 335; SEQ ID NO: 337; and SEQ ID NO: 339, which correspond to polynucleotides encoding the framework regions (FRs or constant regions) of the heavy chain sequence of SEQ ID NO: 321 or the variable heavy chain sequence of SEQ ID NO: 322, and/or one or more of the polynucleotide sequences of SEQ ID NO: 353; SEQ ID NO: 355; SEQ ID NO: 357; and SEQ ID NO: 359, which correspond to the framework regions (FRs or constant regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 331 encoding the heavy chain sequence of SEQ ID NO: 321; the polynucleotide SEQ ID NO: 332 encoding the variable heavy chain sequence of SEQ ID NO: 322; the polynucleotide SEQ ID NO: 351 encoding the light chain sequence of SEQ ID NO: 341; the polynucleotide SEQ ID NO: 352 encoding the variable light chain sequence of SEQ ID NO: 342; polynucleotides encoding the complementarity-determining regions (SEQ ID NO: 334; SEQ ID NO: 336; and SEQ ID NO: 338) of the heavy chain sequence of SEQ ID NO: 321 or the variable heavy chain sequence of SEQ ID NO: 322; polynucleotides encoding the complementarity-determining regions (SEQ ID NO: 354; SEQ ID NO: 356; and SEQ ID NO: 358) of the light chain sequence of SEQ ID NO: 341 or the variable light chain sequence of SEQ ID NO: 342; polynucleotides encoding the framework regions (SEQ ID NO: 333; SEQ ID NO: 335; SEQ ID NO: 337; and SEQ ID NO: 339) of the heavy chain sequence of SEQ ID NO: 321 or the variable heavy chain sequence of SEQ ID NO: 322; and polynucleotides encoding the framework regions (SEQ ID NO: 353; SEQ ID NO: 355; SEQ ID NO: 357; and SEQ ID NO: 359) of the light chain sequence of SEQ ID NO: 341 or the variable light chain sequence of SEQ ID NO: 342.

In a preferred embodiment of the invention, polynucleotides of the invention comprise, or alternatively consist of, polynucleotides encoding Fab (fragment antigen binding) fragments having binding specificity for PCSK9. With respect to antibody Ab9, the polynucleotides encoding the full length Ab9 antibody comprise, or alternatively consist of, the polynucleotide SEQ ID NO: 331 encoding the heavy chain sequence of SEQ ID NO: 321 and the polynucleotide SEQ ID NO: 351 encoding the light chain sequence of SEQ ID NO: 341.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab9 following expression of the full-length polynucleotides in a suitable host. In another embodiment of the invention, anti-PCSK9 antibodies such as Ab9 or Fab fragments thereof may be produced via expression of Ab9 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab10

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 361:

```
                                            (SEQ ID NO: 371)
caggagcagctggaggagtccggggggagacctggtcaagcctgagggatc cctgacactcacctgcacagcctctggattctccttcagtagcagttact ggatatgctgggtccgccaggctccagggaaggggctggagtggatcgca tgcattcgtgctggtggtgggaattactacgcgaactgggcgaaaggccg attcaccatctccagaacctcgtcgaccacggtgactctgcaaatgacca gtctgacagccgcggacacggccacctattttgtgcgagcgatattaat gatgggtggcttggccaattcaacttgtggggcccgggcaccctggtcac cgtctcgagcgcctccaccaagggcccatcggtcttcccctggcaccct cctccaagagcacctctgggggcacagcggccctgggctgcctggtcaag gactacttccccgaaccggtgacggtgtcgtggaactcaggcgcctgac cagcggcgtgcacaccttcccggctgtcctacagtcctcaggactctact ccctcagcagcgtggtgaccgtgccctccagcagcttgggcacccagacc tacatctgcaacgtgaatcacaagcccagcaacaccaaggtggacaagag agttgagcccaaatcttgtgacaaaactcacacatgcccaccgtgcccag cacctgaactcctgggggaccgtcagtcttcctcttccccccaaaaccc aaggacaccctcatgatctcccggacccctgaggtcacatgcgtggtggt ggacgtgagccacgaagaccctgaggtcaagttcaactggtacgtggacg gcgtggaggtgcataatgccaagacaaagccgcgggaggagcagtacgcc agcacgtaccgtgtggtcagcgtcctcaccgtcctgcaccaggactggct gaatggcaaggagtacaagtgcaaggtctccaacaaagcccctcccagccc ccatcgagaaaaccatctccaaagccaaagggcagccccgagaaccacag gtgtacaccctgcccccatcccgggaggagatgaccaagaaccaggtcag cctgacctgcctggtcaaaggcttctatcccagcgacatcgccgtggagt gggagagcaatgggcagccggagaacaactacaagaccacgcctcccgtg ctggactccgacggctccttcttcctctacagcaagctcaccgtggacaa
```

In another embodiment of the invention, the polynucleotides of the invention comprise, or alternatively consist of, the following polynucleotide sequence encoding the variable heavy chain polypeptide sequence of SEQ ID NO: 362:

(SEQ ID NO: 372)
caggagcagctggaggagtccggggggagacctggtcaagcctgagggatc cctgacactcacctgcacagcctctggattctccttcagtagcagttact ggatatgctgggtccgccaggctccagggaaggggctggagtggatcgca tgcattcgtgctggtggtgggaattactacgcgaactgggcgaaaggccg attcaccatctccagaacctcgtcgaccacggtgactctgcaaatgacca gtctgacagccgcggacacggccacctattttttgtgcgagcgatattaat gatgggtggcttggccaattcaacttgtggggcccgggcaccctggtcac cgtctcgagc.

In another embodiment of the invention, polynucleotides of the invention comprise, or alternatively consist of, the following polynucleotide sequence encoding the constant heavy chain polypeptide sequence of SEQ ID NO: 370:

(SEQ ID NO: 380)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcctcccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 381:

(SEQ ID NO: 391)
gccaacattgtgatgacccagactccagcctccgtggaggcagctgtggg aggcacagtcaccatcaagtgccaggccagtcagagcattagtaattact tagcctggtatcagcagaaaccagggcagcctcccaagctcctgatctac aggacatccactctggcatctggggtcccatcgcggttcaaaggcagtgg atccgggacacagttcactctcaccatcagcgacctggagtgtgccgatg ctgccacttactactgtcaaagctattattccgttactactgttgcttat ggaaatactttcggcggagggaccgaggtggtggtcaaacgtacggtagc ggccccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 382:

(SEQ ID NO: 392)
gccaacattgtgatgacccagactccagcctccgtggaggcagctgtggg aggcacagtcaccatcaagtgccaggccagtcagagcattagtaattact tagcctggtatcagcagaaaccagggcagcctcccaagctcctgatctac aggacatccactctggcatctggggtcccatcgcggttcaaaggcagtgg atccgggacacagttcactctcaccatcagcgacctggagtgtgccgatg ctgccacttactactgtcaaagctattattccgttactactgttgcttat ggaaatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 390:

(SEQ ID NO: 400)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 374; SEQ ID NO: 376; and SEQ ID NO: 378, which correspond to polynucleotides encoding the complementarity-determining regions (CDRs, or hypervariable regions) of the heavy chain sequence of SEQ ID NO: 361 or the variable heavy chain sequence of SEQ ID NO: 362, and/or one or more of the polynucleotide sequences of SEQ ID NO: 394; SEQ ID NO: 396; and SEQ ID NO: 398, which correspond to the complementarity-determining regions (CDRs, or hypervariable regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 373; SEQ ID NO: 375; SEQ ID NO: 377; and SEQ ID NO: 379, which correspond to polynucleotides encoding the framework regions (FRs or constant regions) of the heavy chain sequence of SEQ ID NO: 361 or the variable heavy chain sequence of SEQ ID NO: 362, and/or one or more of the polynucleotide sequences of SEQ ID NO: 393; SEQ ID NO: 395; SEQ ID NO: 397; and SEQ ID NO: 399, which correspond to the framework regions (FRs or constant regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 371 encoding the heavy chain sequence of SEQ ID NO: 361; the polynucleotide SEQ ID NO: 372 encoding the variable heavy chain sequence of SEQ ID NO: 362; the polynucleotide SEQ ID NO: 391 encoding the light chain sequence of SEQ ID NO: 381; the polynucleotide SEQ ID NO: 392 encoding the variable light chain sequence of SEQ ID NO: 382; polynucleotides encoding the complementarity-determining regions (SEQ ID NO: 374; SEQ ID NO: 376; and SEQ ID NO: 378) of the heavy chain sequence of SEQ ID NO: 361 or the variable heavy chain sequence of SEQ ID NO: 362; polynucleotides encoding the complementarity-determining regions (SEQ ID NO: 394; SEQ ID NO: 396; and SEQ ID NO: 398) of the light chain sequence of SEQ ID NO: 381 or the variable light chain sequence of SEQ ID NO: 382; polynucleotides encoding the framework regions (SEQ ID NO: 373; SEQ ID NO: 375; SEQ ID NO: 377; and SEQ ID NO: 379) of the heavy chain sequence of SEQ ID NO: 361 or the variable heavy chain sequence of SEQ ID NO: 362; and polynucleotides encoding the framework regions (SEQ ID NO: 393; SEQ ID NO: 395; SEQ ID NO: 397; and SEQ ID NO: 399) of the light chain sequence of SEQ ID NO: 381 or the variable light chain sequence of SEQ ID NO: 382.

In a preferred embodiment of the invention, polynucleotides of the invention comprise, or alternatively consist of, polynucleotides encoding Fab (fragment antigen binding) fragments having binding specificity for PCSK9. With respect to antibody Ab10, the polynucleotides encoding the full length Ab10 antibody comprise, or alternatively consist of, the polynucleotide SEQ ID NO: 371 encoding the heavy chain sequence of SEQ ID NO: 361 and the polynucleotide SEQ ID NO: 391 encoding the light chain sequence of SEQ ID NO: 381.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab10 following expression of the full-length polynucleotides in a suitable host. In another embodiment of the invention, anti-PCSK9 antibodies such as Ab10 or Fab fragments thereof may be produced via expression of Ab10 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab11

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 401:

```
(SEQ ID NO: 411)
gaggtgcagcttgtggagtctgggggaggcttggtccagcctgggggtc cctgagactctcctgtgcagcctctggattcaccgtcagtagcagttact ggatatgctgggtccgtcaggctccagggaaggggctggagtggatcgca tgcattcgtgctggtggtgggaattactacgctaactctgctaaaggccg attcaccatctccagagacaattccaagaacaccctgtatcttcaaatga acagcctgagagctgaggacactgctgtgtattactgtgctagcgatatc aatgatgggtggcttggccaattcaacttgtggggccaagggaccctcgt caccgtctcgagcgcctccaccaagggcccatcggtcttccccctggcac cctcctccaagagcacctctgggggcacagcggccctgggctgcctggtc aaggactacttccccgaaccggtgacggtgtcgtggaactcaggcgccct gaccagcggcgtgcacaccttcccggctgtcctacagtcctcaggactct actccctcagcagcgtggtgaccgtgccctccagcagcttgggcacccag acctacatctgcaacgtgaatcacaagcccagcaacaccaaggtggacaa gagagttgagcccaaatcttgtgacaaaactcacacatgcccaccgtgcc cagcacctgaactcctgggggaccgtcagtcttcctcttcccccaaaa cccaaggacaccctcatgatctcccggacccctgaggtcacatgcgtggt ggtggacgtgagccacgaagaccctgaggtcaagttcaactggtacgtgg acggcgtggaggtgcataatgccaagacaaagccgcgggaggagcagtac gccagcacgtaccgtgtggtcagcgtcctcaccgtcctgcaccaggactg gctgaatggcaaggagtacaagtgcaaggtctccaacaaagccctcccag
``` ccccatcgagaaaaccatctccaaagccaaagggcagccccgagaacca caggtgtacaccctgcccccatcccgggaggagatgaccaagaaccaggt cagcctgacctgcctggtcaaaggcttctatcccagcgacatcgccgtgg agtgggagagcaatgggcagccggagaacaactacaagaccacgcctcc gtgctggactccgacggctccttcttcctctacagcaagctcaccgtgga caagagcaggtggcagcaggggaacgtcttctcatgctccgtgatgcatg aggctctgcacaaccactacacgcagaagagcctctccctgtctccgggt aaa.

In another embodiment of the invention, the polynucleotides of the invention comprise, or alternatively consist of, the following polynucleotide sequence encoding the variable heavy chain polypeptide sequence of SEQ ID NO: 402:

(SEQ ID NO: 412)
gaggtgcagcttgtggagtctgggggaggcttggtccagcctgggggtc cctgagactctcctgtgcagcctctggattcaccgtcagtagcagttact ggatatgctgggtccgtcaggctccagggaaggggctggagtggatcgca tgcattcgtgctggtggtgggaattactacgctaactctgctaaaggccg attcaccatctccagagacaattccaagaacaccctgtatcttcaaatga acagcctgagagctgaggacactgctgtgtattactgtgctagcgatatc aatgatgggtggcttggccaattcaacttgtggggccaagggaccctcgt caccgtctcgagc.

In another embodiment of the invention, polynucleotides of the invention comprise, or alternatively consist of, the following polynucleotide sequence encoding the constant heavy chain polypeptide sequence of SEQ ID NO: 410:

(SEQ ID NO: 420)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact tgacctgggggaccgtcagtcttcctcttccccccaaaacccaaggaca cccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacgccagcacgt accgtgtggtcagcgtcctcaccgtcctgcaccaggactggctgaatggcaag gagtacaagtgcaaggtctccaacaaagcctcccagccccatcgagaa aaccatctccaaagccaaagggcagccccgagaaccacaggtgtacaccc tgccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 421:

(SEQ ID NO: 431)
gccaacattgtgatgacccagtctccatcctccctgtctgcatctgtagg agacagagtcaccatcacttgccaggccagtcagagcattagtaattact tagcctggtatcagcagaaaccagggaaagtccctaagctcctgatctat aggacatccactctggcatctggggtcccatctcgtttcagtggcagtgg atctgggacagatttcactctcaccatcagcagcctgcagcctgaagatg ttgcaacttattactgtcaaagctactattccgttactactgttgcttat ggaaatactttcggcggaggaaccaaggtggaaatcaaacgtacggtggc tgcaccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacgcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 422:

(SEQ ID NO: 432)
gccaacattgtgatgacccagtctccatcctccctgtctgcatctgtagg agacagagtcaccatcacttgccaggccagtcagagcattagtaattact tagcctggtatcagcagaaaccagggaaagtccctaagctcctgatctat aggacatccactctggcatctggggtcccatctcgtttcagtggcagtgg atctgggacagatttcactctcaccatcagcagcctgcagcctgaagatg ttgcaacttattactgtcaaagctactattccgttactactgttgcttat ggaaatactttcggcggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 430:

(SEQ ID NO: 440)
cgtacggtggctgcaccatctgtcttcatcttcccgccatctgatgagca gttgaaatctggaactgcctctgttgtgtgcctgctgaataacttctatc ccagagaggccaaagtacagtggaaggtggataacgccctccaatcgggt -continued

```
aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 414; SEQ ID NO: 416; and SEQ ID NO: 418, which correspond to polynucleotides encoding the complementarity-determining regions (CDRs, or hypervariable regions) of the heavy chain sequence of SEQ ID NO: 401 or the variable heavy chain sequence of SEQ ID NO: 402, and/or one or more of the polynucleotide sequences of SEQ ID NO: 434; SEQ ID NO: 436; and SEQ ID NO: 438, which correspond to the complementarity-determining regions (CDRs, or hypervariable regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 413; SEQ ID NO: 415; SEQ ID NO: 417; and SEQ ID NO: 419, which correspond to polynucleotides encoding the framework regions (FRs or constant regions) of the heavy chain sequence of SEQ ID NO: 401 or the variable heavy chain sequence of SEQ ID NO: 402, and/or one or more of the polynucleotide sequences of SEQ ID NO: 433; SEQ ID NO: 435; SEQ ID NO: 437; and SEQ ID NO: 439, which correspond to the framework regions (FRs or constant regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 411 encoding the heavy chain sequence of SEQ ID NO: 401; the polynucleotide SEQ ID NO: 412 encoding the variable heavy chain sequence of SEQ ID NO: 402; the polynucleotide SEQ ID NO: 431 encoding the light chain sequence of SEQ ID NO: 421; the polynucleotide SEQ ID NO: 432 encoding the variable light chain sequence of SEQ ID NO: 422; polynucleotides encoding the complementarity-determining regions (SEQ ID NO: 414; SEQ ID NO: 416; and SEQ ID NO: 418) of the heavy chain sequence of SEQ ID NO: 401 or the variable heavy chain sequence of SEQ ID NO: 402; polynucleotides encoding the complementarity-determining regions (SEQ ID NO: 434; SEQ ID NO: 436; and SEQ ID NO: 438) of the light chain sequence of SEQ ID NO: 421 or the variable light chain sequence of SEQ ID NO: 422; polynucleotides encoding the framework regions (SEQ ID NO: 413; SEQ ID NO: 415; SEQ ID NO: 417; and SEQ ID NO: 419) of the heavy chain sequence of SEQ ID NO: 401 or the variable heavy chain sequence of SEQ ID NO: 402; and polynucleotides encoding the framework regions (SEQ ID NO: 433; SEQ ID NO: 435; SEQ ID NO: 437; and SEQ ID NO: 439) of the light chain sequence of SEQ ID NO: 421 or the variable light chain sequence of SEQ ID NO: 422.

In a preferred embodiment of the invention, polynucleotides of the invention comprise, or alternatively consist of, polynucleotides encoding Fab (fragment antigen binding) fragments having binding specificity for PCSK9. With respect to antibody Ab11, the polynucleotides encoding the full length Ab11 antibody comprise, or alternatively consist of, the polynucleotide SEQ ID NO: 411 encoding the heavy chain sequence of SEQ ID NO: 401 and the polynucleotide SEQ ID NO: 431 encoding the light chain sequence of SEQ ID NO: 421.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab11 following expression of the full-length polynucleotides in a suitable host. In another embodiment of the invention, anti-PCSK9 antibodies such as Ab11 or Fab fragments thereof may be produced via expression of Ab11 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab12

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 441:

```
                                           (SEQ ID NO: 451)
gaggtgcagcttgtggagtctgggggaggcttggtccagcctgggggtc cctgagactctcctgtgcagcctctggattcaccgtcagtagcagttact ggatatgctgggtccgtcaggctccagggaaggggctggagtggatcgca tgcattcgtgctggtggtgggaattactacgctaactctgctaaaggccg attcaccatctccagagacaattccaagaacaccctgtatcttcaaatga acagcctgagagctgaggacactgctgtgtattactgtgctagcgatatc aatgatgggtggcttggccaattcaacttgtgggccaagggaccctcgt caccgtctcgagcgcctccaccaagggcccatcggtcttcccctggcac cctcctccaagagcacctctgggggcacagcggccctgggctgcctggtc aaggactacttccccgaaccggtgacggtgtcgtggaactcaggcgccct
``` gaccagcggcgtgcacaccttcccggctgtcctacagtcctcaggactct actccctcagcagcgtggtgaccgtgccctccagcagcttgggcacccag acctacatctgcaacgtgaatcacaagcccagcaacaccaaggtggacaa gagagttgagcccaaatcttgtgacaaaactcacacatgccaccgtgcc cagcacctgaactcctgggggaccgtcagtcttcctcttcccccaaaa cccaaggacaccctcatgatctcccggacccctgaggtcacatgcgtggt ggtggacgtgagccacgaagaccctgaggtcaagttcaactggtacgtgg acggcgtggaggtgcataatgccaagacaaagccgcgggaggagcagtac gccagcacgtaccgtgtggtcagcgtcctcaccgtcctgcaccaggactg gctgaatggcaaggagtacaagtgcaaggtctccaacaaagccctcccag cccccatcgagaaaaccatctccaaagccaaagggcagccccgagaacca caggtgtacaccctgccccatcccgggaggagatgaccaagaaccaggt cagcctgacctgcctggtcaaaggcttctatcccagcgacatcgccgtgg agtgggagagcaatgggcagccggagaacaactacaagaccacgcctccc gtgctggactccgacggctccttcttcctctacagcaagctcaccgtgga caagagcaggtggcagcaggggaacgtcttctcatgctccgtgatgcatg aggctctgcacaaccactacacgcagaagagcctctccctgtctccgggt aaa.

In another embodiment of the invention, the polynucleotides of the invention comprise, or alternatively consist of, the following polynucleotide sequence encoding the variable heavy chain polypeptide sequence of SEQ ID NO: 442:

(SEQ ID NO: 452)
gaggtgcagcttgtggagtctgggggaggcttggtccagcctggggggtc cctgagactctcctgtgcagcctctggattcaccgtcagtagcagttact ggatatgctgggtccgtcaggctccagggaaggggctggagtggatcgca tgcattcgtgctggtggtgggaattactacgctaactctgctaaaggccg attcaccatctccagagacaattccaagaacaccctgtatcttcaaatga acagcctgagagctgaggacactgctgtgtattactgtgctagcgatatc aatgatgggtggcttggccaattcaacttgtggggccaagggaccctcgt caccgtctcgagc.

In another embodiment of the invention, polynucleotides of the invention comprise, or alternatively consist of, the following polynucleotide sequence encoding the constant heavy chain polypeptide sequence of SEQ ID NO: 450:

(SEQ ID NO: 460)
gcctccaccaagggcccatcggtcttccccctggcacctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgccaccgtgcccagcac ctgaactcctgggggaccgtcagtcttcctcttcccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 461:

(SEQ ID NO: 471)
gccaacattgtgatgacccagtctccatcctccctgtctgcatctgtag gagacagagtcaccatcaagtgccaggccagtcagagcattagtaatta cttagcctggtatcagcagaaaccagggaaagtccctaagctcctgatc tataggacatccactctggcatctggggtcccatctcgtttcagtggca gtggatctgggacagatttcactctcaccatcagcagcctgcagcctga agatgttgcaacttattactgtcaaagctactattccgttactactgtt gcttatggaaatacttcggcggaggaaccaaggtggaaatcaaacgta cggtggctgcaccatctgtcttcatcttcccgccatctgatgagcagtt gaaatctggaactgcctctgttgtgtgcctgctgaataacttctatccc agagaggccaaagtacagtggaaggtggataacgccctccaatcgggta actcccaggagagtgtcacagagcaggacagcaaggacagcacctacag cctcagcagcaccctgacgctgagcaaagcagactacgagaaacacaaa gtctacgcctgcgaagtcacccatcagggcctgagctcgcccgtcacaa agagcttcaacaggggagagtgt.

In another embodiment of the invention, polynucleotides of the invention comprise, or alternatively consist of, the following polynucleotide sequence encoding the variable light chain polypeptide sequence of SEQ ID NO: 462:

(SEQ ID NO: 472)
gccaacattgtgatgacccagtctccatcctccctgtctgcatctgtag gagacagagtcaccatcaagtgccaggccagtcagagcattagtaatta cttagcctggtatcagcagaaaccagggaaagtcccttaagctcctgatc -continued

```
tataggacatccactctggcatctggggtcccatctcgtttcagtggca gtggatctgggacagatttcactctcaccatcagcagcctgcagcctga agatgttgcaacttattactgtcaaagctactattccgttactactgtt gcttatggaaatactttcggcggaggaaccaaggtggaaatcaaa.
```

In another embodiment of the invention, polynucleotides of the invention comprise, or alternatively consist of, the following polynucleotide sequence encoding the constant light chain polypeptide sequence of SEQ ID NO: 470:

(SEQ ID NO: 480)
```
cgtacggtggctgcaccatctgtcttcatcttcccgccatctgatgagc agttgaaatctggaactgcctctgttgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 454; SEQ ID NO: 456; and SEQ ID NO: 458, which correspond to polynucleotides encoding the complementarity-determining regions (CDRs, or hypervariable regions) of the heavy chain sequence of SEQ ID NO: 441 or the variable heavy chain sequence of SEQ ID NO: 442, and/or one or more of the polynucleotide sequences of SEQ ID NO: 474; SEQ ID NO: 476; and SEQ ID NO: 478, which correspond to the complementarity-determining regions (CDRs, or hypervariable regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 453; SEQ ID NO: 455; SEQ ID NO: 457; and SEQ ID NO: 459, which correspond to polynucleotides encoding the framework regions (FRs or constant regions) of the heavy chain sequence of SEQ ID NO: 441 or the variable heavy chain sequence of SEQ ID NO: 442, and/or one or more of the polynucleotide sequences of SEQ ID NO: 473; SEQ ID NO: 475; SEQ ID NO: 477; and SEQ ID NO: 479, which correspond to the framework regions (FRs or constant regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 451 encoding the heavy chain sequence of SEQ ID NO: 441; the polynucleotide SEQ ID NO: 452 encoding the variable heavy chain sequence of SEQ ID NO: 442; the polynucleotide SEQ ID NO: 471 encoding the light chain sequence of SEQ ID NO: 461; the polynucleotide SEQ ID NO: 472 encoding the variable light chain sequence of SEQ ID NO: 462; polynucleotides encoding the complementarity-determining regions (SEQ ID NO: 454; SEQ ID NO: 456; and SEQ ID NO: 458) of the heavy chain sequence of SEQ ID NO: 441 or the variable heavy chain sequence of SEQ ID NO: 442; polynucleotides encoding the complementarity-determining regions (SEQ ID NO: 474; SEQ ID NO: 476; and SEQ ID NO: 478) of the light chain sequence of SEQ ID NO: 461 or the variable light chain sequence of SEQ ID NO: 462; polynucleotides encoding the framework regions (SEQ ID NO: 453; SEQ ID NO: 455; SEQ ID NO: 457; and SEQ ID NO: 459) of the heavy chain sequence of SEQ ID NO: 441 or the variable heavy chain sequence of SEQ ID NO: 442; and polynucleotides encoding the framework regions (SEQ ID NO: 473; SEQ ID NO: 475; SEQ ID NO: 477; and SEQ ID NO: 479) of the light chain sequence of SEQ ID NO: 461 or the variable light chain sequence of SEQ ID NO: 462.

In a preferred embodiment of the invention, polynucleotides of the invention comprise, or alternatively consist of, polynucleotides encoding Fab (fragment antigen binding) fragments having binding specificity for PCSK9. With respect to antibody Ab12, the polynucleotides encoding the full length Ab12 antibody comprise, or alternatively consist of, the polynucleotide SEQ ID NO: 451 encoding the heavy chain sequence of SEQ ID NO: 441 and the polynucleotide SEQ ID NO: 471 encoding the light chain sequence of SEQ ID NO: 461.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab12 following expression of the full-length polynucleotides in a suitable host. In another embodiment of the invention, anti-PCSK9 antibodies such as Ab12 or Fab fragments thereof may be produced via expression of Ab12 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab13

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 481:

(SEQ ID NO: 491)
cagtcggtggaggagtccgggggtcgcctggtcacgcctgggacacccc tgacactcacctgcacagtctctggaatcgacctcagtacctatggagt gggctgggtccgccaggctccagggaaggggctggaatacatcggaatc attagtagtagtggtagcacatactacgcgagctgggcgaaaggccgat tcaccatctccaaaacctcgtcgaccacggtggatctgaaaatgaccag tctgacaaccgaggacacggccacctatttctgtgccagagattggtct agtactactggttattatgggtattttaatatgtggggcccgggcaccc tcgtcaccgtctcgagcgcctccaccaagggcccatcggtcttccccct ggcaccctcctccaagagcacctctgggggcacagcggccctgggctgc ctggtcaaggactacttccccgaaccggtgacggtgtcgtggaactcag gcgccctgaccagcggcgtgcacaccttcccggctgtcctacagtcctc aggactctactccctcagcagcgtggtgaccgtgccctccagcagcttg ggcacccagacctacatctgcaacgtgaatcacaagcccagcaacacca aggtggacaagagagttgagcccaaatcttgtgacaaaactcacacatg cccaccgtgcccagcacctgaactcctggggggaccgtcagtcttcctc ttccccccaaaacccaaggacaccctcatgatctcccggacccctgagg tcacatgcgtggtggtggacgtgagccacgaagaccctgaggtcaagtt caactggtacgtggacggcgtggaggtgcataatgccaagacaaagccg cgggaggagcagtacgccagcacgtaccgtgtggtcagcgtcctcaccg tcctgcaccaggactggctgaatggcaaggagtacaagtgcaaggtctc caacaaagccctcccagcccccatcgagaaaaccatctccaaagccaaa gggcagccccgagaaccacaggtgtacaccctgcccccatcccgggagg agatgaccaagaaccaggtcagcctgacctgcctggtcaaaggcttcta tcccagcgacatcgccgtggagtgggagagcaatgggcagccggagaac aactacaagaccacgcctcccgtgctggactccgacggctccttcttcc tctacagcaagctcaccgtggacaagagcaggtggcagcaggggaacgt cttctcatgctccgtgatgcatgaggctctgcacaaccactacacgcag aagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 482:

(SEQ ID NO: 492)
cagtcggtggaggagtccgggggtcgcctggtcacgcctgggacacccc tgacactcacctgcacagtctctggaatcgacctcagtacctatggagt gggctgggtccgccaggctccagggaaggggctggaatacatcggaatc attagtagtagtggtagcacatactacgcgagctgggcgaaaggccgat tcaccatctccaaaacctcgtcgaccacggtggatctgaaaatgaccag tctgacaaccgaggacacggccacctatttctgtgccagagattggtct agtactactggttattatgggtattttaatatgtggggcccgggcaccc tcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 490:

(SEQ ID NO: 500)
gcctccaccaagggcccatcggtcttcccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 501:

(SEQ ID NO: 511)
gcattcgaattgacccagactccatcccccgtgtctgcagctgtgggag gcacagtcaccatcaagtgccaggccagtcagagcattagcactgcatt agcctggtatcagcagaaaccagggcagcctcccaagctcctgatctat ggtgcatccaatctggaatctggggtcccatcgcggttcagcggcagtg gatctgggacagttcactctcaccatcagcgacctggagtgtgccga tgctgccatttactactgtcaaagctcttatggtagtagtactttggct ttcggcggagggaccgaggtggtggtcaaacgtacggtagcggcccat ctgtcttcatcttcccgccatctgatgagcagttgaaatctggaactgc ctctgttgtgtgcctgctgaataacttctatcccagagaggccaaagta cagtggaaggtggataacgcccctccaatcgggtaactcccaggagagtg tcacagagcaggacagcaaggacagcacctacagcctcagcagcaccct gacgctgagcaaagcagactacgagaaacacaaagtctacgcctgcgaa -continued

```
gtcacccatcagggcctgagctcgcccgtcacaaagagcttcaacaggg gagagtgt.
```

In another embodiment of the invention, polynucleotides of the invention comprise, or alternatively consist of, the following polynucleotide sequence encoding the variable light chain polypeptide sequence of SEQ ID NO: 502:

```
                                          (SEQ ID NO: 512)
gcattcgaattgacccagactccatcccccgtgtctgcagctgtggga ggcacagtcaccatcaagtgccaggccagtcagagcattagcactgca ttagcctggtatcagcagaaaccagggcagcctcccaagctcctgatc tatggtgcatccaatctggaatctggggtcccatcgcggttcagcggc agtggatctgggacacagttcactctcaccatcagcgacctggagtgt gccgatgctgccatttactactgtcaaagctcttatggtagtagtact ttggctttcggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 510:

```
                                          (SEQ ID NO: 520)
cgtacggtagcggcccatctgtcttcatcttcccgccatctgatgag cagttgaaatctggaactgcctctgttgtgtgcctgctgaataacttc tatcccagagaggccaaagtacagtggaaggtggataacgccctccaa tcgggtaactcccaggagagtgtcacagagcaggacagcaaggacagc acctacagcctcagcagcaccctgacgctgagcaaagcagactacgag aaacacaaagtctacgcctgcgaagtcacccatcagggcctgagctcg cccgtcacaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 494; SEQ ID NO: 496; and SEQ ID NO: 498, which correspond to polynucleotides encoding the complementarity-determining regions (CDRs, or hypervariable regions) of the heavy chain sequence of SEQ ID NO: 481 or the variable heavy chain sequence of SEQ ID NO: 482, and/or one or more of the polynucleotide sequences of SEQ ID NO: 514; SEQ ID NO: 516; and SEQ ID NO: 518, which correspond to the complementarity-determining regions (CDRs, or hypervariable regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 493; SEQ ID NO: 495; SEQ ID NO: 497; and SEQ ID NO: 499, which correspond to polynucleotides encoding the framework regions (FRs or constant regions) of the heavy chain sequence of SEQ ID NO: 481 or the variable heavy chain sequence of SEQ ID NO: 482, and/or one or more of the polynucleotide sequences of SEQ ID NO: 513; SEQ ID NO: 515; SEQ ID NO: 517; and SEQ ID NO: 519, which correspond to the framework regions (FRs or constant regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 491 encoding the heavy chain sequence of SEQ ID NO: 481; the polynucleotide SEQ ID NO: 492 encoding the variable heavy chain sequence of SEQ ID NO: 482; the polynucleotide SEQ ID NO: 511 encoding the light chain sequence of SEQ ID NO: 501; the polynucleotide SEQ ID NO: 512 encoding the variable light chain sequence of SEQ ID NO: 502; polynucleotides encoding the complementarity-determining regions (SEQ ID NO: 494; SEQ ID NO: 496; and SEQ ID NO: 498) of the heavy chain sequence of SEQ ID NO: 481 or the variable heavy chain sequence of SEQ ID NO: 482; polynucleotides encoding the complementarity-determining regions (SEQ ID NO: 514; SEQ ID NO: 516; and SEQ ID NO: 518) of the light chain sequence of SEQ ID NO: 501 or the variable light chain sequence of SEQ ID NO: 502; polynucleotides encoding the framework regions (SEQ ID NO: 493; SEQ ID NO: 495; SEQ ID NO: 497; and SEQ ID NO: 499) of the heavy chain sequence of SEQ ID NO: 481 or the variable heavy chain sequence of SEQ ID NO: 482; and polynucleotides encoding the framework regions (SEQ ID NO: 513; SEQ ID NO: 515; SEQ ID NO: 517; and SEQ ID NO: 519) of the light chain sequence of SEQ ID NO: 501 or the variable light chain sequence of SEQ ID NO: 502.

In a preferred embodiment of the invention, polynucleotides of the invention comprise, or alternatively consist of, polynucleotides encoding Fab (fragment antigen binding) fragments having binding specificity for PCSK9. With respect to antibody Ab13, the polynucleotides encoding the full length Ab13 antibody comprise, or alternatively consist of, the polynucleotide SEQ ID NO: 491 encoding the heavy chain sequence of SEQ ID NO: 481 and the polynucleotide SEQ ID NO: 511 encoding the light chain sequence of SEQ ID NO: 501.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab13 following expression of the full-length polynucleotides in a suitable host. In another embodiment of the invention, anti-PCSK9 antibodies such as Ab13 or Fab fragments thereof may be produced via expression of Ab13 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab14

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 521:

(SEQ ID NO: 531)
caggagcagctggaggagtccggggagacctggtcaagcctgagggat ccctgacactcacctgcacaggttctggattctccttcagtagcatcgc ctacatgtgctggatccgccaggctccagggaaggggctggagtggatc ggatgcattggttctggtagtgggaacacttactacgcgaactgggcga aaggccgattcaccatctccaaaagctcgtcgaccacggtgactctgca aatgaccagtctgacagccgcggacacggccacttatttctgtgcgagc gatactaataatgggtggcttggccaattcaacttgtggggccagggca ccctcgtcaccgtctcgagcgcctccaccaagggcccatcggtcttccc cctggcaccctcctccaagagcacctctgggggcacagcggccctgggc tgcctggtcaaggactacttccccgaaccggtgacggtgtcgtggaact caggcgccctgaccagcggcgtgcacaccttcccggctgtcctacagtc ctcaggactctactccctcagcagcgtggtgaccgtgccctccagcagc ttgggcacccagacctacatctgcaacgtgaatcacaagcccagcaaca ccaaggtggacaagagagttgagcccaaatcttgtgacaaaactcacac atgcccaccgtgcccagcacctgaactcctggggggaccgtcagtcttc ctcttccccccaaaacccaaggacaccctcatgatctcccggacccctg aggtcacatgcgtggtggtggacgtgagccacgaagaccctgaggtcaa gttcaactggtacgtggacggcgtggaggtgcataatgccaagacaaag ccgcggggaggagcagtacgccagcacgtaccgtgtggtcagcgtcctca ccgtcctgcaccaggactggctgaatggcaaggagtacaagtgcaaggt ctccaacaaagccctcccagcccccatcgagaaaaccatctccaaagcc aaagggcagccccgagaaccacaggtgtacaccctgcccccatcccggg aggagatgaccaagaaccaggtcagcctgacctgcctggtcaaaggctt ctatcccagcgacatcgccgtggagtgggagagcaatgggcagccggag aacaactacaagaccacgcctcccgtgctggactccgacggctccttct tcctctacagcaagctcaccgtggacaagagcaggtggcagcaggggaa cgtcttctcatgctccgtgatgcatgaggctctgcacaaccactacacg cagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 522:

(SEQ ID NO: 532)
caggagcagctggaggagtccggggagacctggtcaagcctgagggat ccctgacactcacctgcacaggttctggattctccttcagtagcatcgc ctacatgtgctggatccgccaggctccagggaaggggctggagtggatc ggatgcattggttctggtagtgggaacacttactacgcgaactgggcga aaggccgattcaccatctccaaaagctcgtcgaccacggtgactctgca aatgaccagtctgacagccgcggacacggccacttatttctgtgcgagc gatactaataatgggtggcttggccaattcaacttgtggggccagggca ccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 530:

(SEQ ID NO: 540)
gcctccaccaagggcccatcggtcttccccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaaggccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 541:

(SEQ ID NO: 551)
gctgacattgtgatgacccagactccagcctcggtgtctgcagctgtgg gaggcacagtcaccatcaattgccaggccagtcagagcattagtagcta cttagcctggtatcagcagaaaccagggcagcctcccaagctcctgatc -continued

```
tacagggcatccactctggcatctggggtcccatcgcggttcaaaggca gtggatctgggacacagttcactctcaccatcagcgacctggagtgtgc cgatgctgccacttactactgtcaaggctattattccgttactactaat acttatggaaatactttcggcggagggaccgaggtggtggtcaaacgta cggtagcggcccatctgtcttcatcttcccgccatctgatgagcagtt gaaatctggaactgcctctgttgtgtgcctgctgaataacttctatccc agagaggccaaagtacagtggaaggtggataacgccctccaatcgggta actcccaggagagtgtcacagagcaggacagcaaggacagcacctacag cctcagcagcaccctgacgctgagcaaagcagactacgagaaacacaaa gtctacgcctgcgaagtcacccatcagggcctgagctcgcccgtcacaa agagcttcaacaggggagagtgt.
```

In another embodiment of the invention, polynucleotides of the invention comprise, or alternatively consist of, the following polynucleotide sequence encoding the variable light chain polypeptide sequence of SEQ ID NO: 542: gctgacattgtgatgacccagactccagcctcg-gtgtctgcagctgtgggaggcacagtcaccatcaattgccaggccagtcagagcattagtagctacttagcctggtat-cagcagaaaccagggcagcctc-ccaagctcctgatctacagggcatccactctggcatctg gggtcccatcgcggt-tcaaaggcagtggatctgggacacagttcactctcaccatcagcgacctggagtg tgccgatgctgccact tactactgtcaaggctattattccgt-tactactaatacttatggaaatactttcggcggagggaccgaggtggtggtcaaa (SEQ ID NO: 552).

In another embodiment of the invention, polynucleotides of the invention comprise, or alternatively consist of, the following polynucleotide sequence encoding the constant light chain polypeptide sequence of SEQ ID NO: 550:

```
                                    (SEQ ID NO: 560)
cgtacggtagcggcccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 534; SEQ ID NO: 536; and SEQ ID NO: 538, which correspond to polynucleotides encoding the complementarity-determining regions (CDRs, or hypervariable regions) of the heavy chain sequence of SEQ ID NO: 521 or the variable heavy chain sequence of SEQ ID NO: 522, and/or one or more of the polynucleotide sequences of SEQ ID NO: 554; SEQ ID NO: 556; and SEQ ID NO: 558, which correspond to the complementarity-determining regions (CDRs, or hypervariable regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 533; SEQ ID NO: 535; SEQ ID NO: 537; and SEQ ID NO: 539, which correspond to polynucleotides encoding the framework regions (FRs or constant regions) of the heavy chain sequence of SEQ ID NO: 521 or the variable heavy chain sequence of SEQ ID NO: 522, and/or one or more of the polynucleotide sequences of SEQ ID NO: 553; SEQ ID NO: 555; SEQ ID NO: 557; and SEQ ID NO: 559, which correspond to the framework regions (FRs or constant regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 531 encoding the heavy chain sequence of SEQ ID NO: 521; the polynucleotide SEQ ID NO: 532 encoding the variable heavy chain sequence of SEQ ID NO: 522; the polynucleotide SEQ ID NO: 551 encoding the light chain sequence of SEQ ID NO: 541; the polynucleotide SEQ ID NO: 552 encoding the variable light chain sequence of SEQ ID NO: 542; polynucleotides encoding the complementarity-determining regions (SEQ ID NO: 534; SEQ ID NO: 536; and SEQ ID NO: 538) of the heavy chain sequence of SEQ ID NO: 521 or the variable heavy chain sequence of SEQ ID NO: 522; polynucleotides encoding the complementarity-determining regions (SEQ ID NO: 554; SEQ ID NO: 556; and SEQ ID NO: 558) of the light chain sequence of SEQ ID NO: 541 or the variable light chain sequence of SEQ ID NO: 542; polynucleotides encoding the framework regions (SEQ ID NO: 533; SEQ ID NO: 535; SEQ ID NO: 537; and SEQ ID NO: 539) of the heavy chain sequence of SEQ ID NO: 521 or the variable heavy chain sequence of SEQ ID NO: 522; and polynucleotides encoding the framework regions (SEQ ID NO: 553; SEQ ID NO: 555; SEQ ID NO: 557; and SEQ ID NO: 559) of the light chain sequence of SEQ ID NO: 541 or the variable light chain sequence of SEQ ID NO: 542.

In a preferred embodiment of the invention, polynucleotides of the invention comprise, or alternatively consist of, polynucleotides encoding Fab (fragment antigen binding) fragments having binding specificity for PCSK9. With respect to antibody Ab14, the polynucleotides encoding the full length Ab14 antibody comprise, or alternatively consist of, the polynucleotide SEQ ID NO: 531 encoding the heavy chain sequence of SEQ ID NO: 521 and the polynucleotide SEQ ID NO: 551 encoding the light chain sequence of SEQ ID NO: 541.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab14 following expression of the full-length polynucleotides in a suitable host. In another embodiment of the invention, anti-PCSK9 antibodies such as Ab14 or Fab fragments thereof may be produced via expression of Ab14 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab15

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 561:

(SEQ ID NO: 571)
caggagcagctggaggagtccggggagacctggtcaagcctgagggat ccctgacactcacctgcacagcctctggattctccttcagtagcagcta ctggatatgctgggtccgccaggctccagggaagggactggagtggatc gcatgcattgatgctggtaatagtggtagcacttactacgcgagctggg cgaaaggccgattcaccatctccaaggcctcgtcgaccacggtgactct gcaaatgaccagtctgacagccgcggacacggccacctattttttgtgcg agcgatcttaatgatgggtggcttggccaattcaacttgtggggccgg gcaccctcgtcaccgtctcgagcgcctccaccaagggcccatcggtctt cccctggcaccctcctccaagagcacctctgggggcacagcggccctg ggctgcctggtcaaggactacttccccgaaccggtgacggtgtcgtgga actcaggcgccctgaccagcggcgtgcacaccttcccggctgtcctaca gtcctcaggactctactccctcagcagcgtggtgaccgtgccctccagc agcttgggcacccagacctacatctgcaacgtgaatcacaagcccagca acaccaaggtggacaagagagttgagcccaaatcttgtgacaaaactca cacatgcccaccgtgcccagcacctgaactcctgggggaccgtcagtc ttcctcttccccccaaaacccaaggacaccctcatgatctcccggaccc ctgaggtcacatgcgtggtggtggacgtgagccacgaagaccctgaggt caagttcaactggtacgtggacggcgtggaggtgcataatgccaagaca aagccgcgggaggagcagtacgccagcacgtaccgtgtggtcagcgtcc tcaccgtcctgcaccaggactggctgaatggcaaggagtacaagtgcaa ggtctccaacaaagccctcccagcccccatcgagaaaaccatctccaaa gccaaagggcagccccgagaaccacaggtgtacaccctgcccccatccc gggaggagatgaccaagaaccaggtcagcctgacctgcctggtcaaagg cttctatcccagcgacatcgccgtggagtgggagagcaatgggcagccg gagaacaactacaagaccacgcctcccgtgctggactccgacggctcct tcttcctctacagcaagctcaccgtggacaagagcaggtggcagcaggg gaacgtcttctcatgctccgtgatgcatgaggctctgcacaaccactac acgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 562:

(SEQ ID NO: 572)
caggagcagctggaggagtccggggagacctggtcaagcctgagggat ccctgacactcacctgcacagcctctggattctccttcagtagcagcta ctggatatgctgggtccgccaggctccagggaagggactggagtggatc gcatgcattgatgctggtaatagtggtagcacttactacgcgagctggg cgaaaggccgattcaccatctccaaggcctcgtcgaccacggtgactct gcaaatgaccagtctgacagccgcggacacggccacctattttttgtgcg agcgatcttaatgatgggtggcttggccaattcaacttgtggggccgg gcaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 570:

(SEQ ID NO: 580)
gcctccaccaagggcccatcggtcttccccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctgggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag ccccatcgagaaaaccatctccaaagcaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 581:

(SEQ ID NO: 591)
gccaacatcgtgatgacccagactccatccccgtgtctggagctgtgg gaggcacagtcaccatcaagtgccaggccagtcagagcattagtgacta cttagcctggtatcagcagaaaccagggcagcctcccaaactcctgatc tacagggcatccactctggcatctggggtcccatcgcggttcagaggca gtggatctgggacagagtacactctcaccatcaccgacctggagtgtgc cgatgctgccacttactactgtcaaagctattattccgttactactaat acttatggaaatactttcggcggagggaccgaggtggtggtcaaacgta cggtagcggcccatctgtcttcatcttcccgccatctgatgagcagtt gaaatctggaactgcctctgttgtgtgcctgctgaataacttctatccc agagaggccaaagtacagtggaaggtggataacgccctccaatcgggta actcccaggagagtgtcacagagcaggacagcaaggacagcacctacag cctcagcagcacctgacgctgagcaaagcagactacgagaaacacaaa gtctacgcctgcgaagtcacccatcagggcctgagctcgcccgtcacaa agagcttcaacaggggagagtgt.

In another embodiment of the invention, polynucleotides of the invention comprise, or alternatively consist of, the following polynucleotide sequence encoding the variable light chain polypeptide sequence of SEQ ID NO: 582:

(SEQ ID NO: 592)
gccaacatcgtgatgacccagactccatccccgtgtctggagctgtgg gaggcacagtcaccatcaagtgccaggccagtcagagcattagtgacta cttagcctggtatcagcagaaaccagggcagcctcccaaactcctgatc tacagggcatccactctggcatctggggtcccatcgcggttcagaggca gtggatctgggacagagtacactctcaccatcaccgacctggagtgtgc cgatgctgccacttactactgtcaaagctattattccgttactactaat acttatggaaatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 590:

(SEQ ID NO: 600)
cgtacggtagcggcccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcacctgacgctgagcaaagcagactacgagaaaca caaagtctacgcctgcgaagtcacccatcagggcctgagctcgcccgtc acaaagagcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 574; SEQ ID NO: 576; and SEQ ID NO: 578, which correspond to polynucleotides encoding the complementarity-determining regions (CDRs, or hypervariable regions) of the heavy chain sequence of SEQ ID NO: 561 or the variable heavy chain sequence of SEQ ID NO: 562, and/or one or more of the polynucleotide sequences of SEQ ID NO: 594; SEQ ID NO: 596; and SEQ ID NO: 598, which correspond to the complementarity-determining regions (CDRs, or hypervariable regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 573; SEQ ID NO: 575; SEQ ID NO: 577; and SEQ ID NO: 579, which correspond to polynucleotides encoding the framework regions (FRs or constant regions) of the heavy chain sequence of SEQ ID NO: 561 or the variable heavy chain sequence of SEQ ID NO: 562, and/or one or more of the polynucleotide sequences of SEQ ID NO: 593; SEQ ID NO: 595; SEQ ID NO: 597; and SEQ ID NO: 599, which correspond to the framework regions (FRs or constant regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 571 encoding the heavy chain sequence of SEQ ID NO: 561; the polynucleotide SEQ ID NO: 572 encoding the variable heavy chain sequence of SEQ ID NO: 562; the polynucleotide SEQ ID NO: 591 encoding the light chain sequence of SEQ ID NO: 581; the polynucleotide SEQ ID NO: 592 encoding the variable light chain sequence of SEQ ID NO: 582; polynucleotides encoding the complementarity-determining regions (SEQ ID NO: 574; SEQ ID NO: 576; and SEQ ID NO: 578) of the heavy chain sequence of SEQ ID NO: 561 or the variable heavy chain sequence of SEQ ID NO: 562; polynucleotides encoding the complementarity-determining regions (SEQ ID NO: 594; SEQ ID NO: 596; and SEQ ID NO: 598) of the light chain sequence of SEQ ID NO: 581 or the variable light chain sequence of SEQ ID NO: 582; polynucleotides encoding the framework regions (SEQ ID NO: 573; SEQ ID NO: 575; SEQ ID NO: 577; and SEQ ID NO: 579) of the heavy chain sequence of SEQ ID NO: 561 or the variable heavy chain sequence of SEQ ID NO: 562; and polynucleotides encoding the framework regions (SEQ ID NO: 593; SEQ ID NO: 595; SEQ ID NO: 597; and SEQ ID NO: 599) of the light chain sequence of SEQ ID NO: 581 or the variable light chain sequence of SEQ ID NO: 582.

In a preferred embodiment of the invention, polynucleotides of the invention comprise, or alternatively consist of, polynucleotides encoding Fab (fragment antigen binding) fragments having binding specificity for PCSK9. With respect to antibody Ab15, the polynucleotides encoding the full length Ab15 antibody comprise, or alternatively consist of, the polynucleotide SEQ ID NO: 571 encoding the heavy chain sequence of SEQ ID NO: 561 and the polynucleotide SEQ ID NO: 591 encoding the light chain sequence of SEQ ID NO: 581.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab15 following expression of the full-length polynucleotides in a suitable host. In another embodiment of the invention, anti-PCSK9 antibodies such as Ab15 or Fab fragments thereof may be produced via expression of Ab15 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab16

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 601:

```
                                        (SEQ ID NO: 611)
caggagcagctggtggagtccggggaggcctggtccagcctgagggat ccctgacactcacctgcacagcctctggattctcctttagtagtgatta ctggatatgctgggtccgccaggctccagggaagggcctggagtggatc ggatgcattcgtgatggtggtgggagttactacgcgaactgggcgaaag gccgactcaccatctccatgacctcgtcgaccacggtgggtctgaaaat gaccagtctgacagccgcggacacggccacgtattttttgtgcgagcgat attaatgatgggtggcttggccaattcaacttgtggggcccagggaccc tcgtcaccgtctcgagcgcctccaccaagggcccatcggtcttcccct ggcaccctcctccaagagcacctctgggggcacagcggccctgggctgc ctggtcaaggactacttccccgaaccggtgacggtgtcgtggaactcag gcgccctgaccagcggcgtgcacaccttccccggctgtcctacagtcctc aggactctactccctcagcagcgtggtgaccgtgccctccagcagcttg ggcacccagacctacatctgcaacgtgaatcacaagcccagcaacacca aggtggacaagagagttgagcccaaatcttgtgacaaaactcacacatg cccaccgtgcccagcacctgaactcctgggggggaccgtcagtcttcctc ttccccccaaaacccaaggacacccctcatgatctcccggacccctgagg
```

-continued
```
tcacatgcgtggtggtggacgtgagccacgaagaccctgaggtcaagtt caactggtacgtggacggcgtggaggtgcataatgccaagacaaagccg cgggaggagcagtacgccagcacgtaccgtgtggtcagcgtcctcaccg tcctgcaccaggactggctgaatggcaaggagtacaagtgcaaggtctc caacaaagccctcccagcccccatcgagaaaaccatctccaaagccaaa gggcagccccgagaaccacaggtgtacaccctgcccccatcccgggagg agatgaccaagaaccaggtcagcctgacctgcctggtcaaaggcttcta tcccagcgacatcgccgtggagtgggagagcaatgggcagccggagaac aactacaagaccacgcctcccgtgctggactccgacggctccttcttcc tctacagcaagctcaccgtggacaagagcaggtggcagcaggggaacgt cttctcatgctccgtgatgcatgaggctctgcacaaccactacacgcag aagagcctctccctgtctccgggtaaa.
```

In another embodiment of the invention, the polynucleotides of the invention comprise, or alternatively consist of, the following polynucleotide sequence encoding the variable heavy chain polypeptide sequence of SEQ ID NO: 602:

```
                                        (SEQ ID NO: 612)
caggagcagctggtggagtccggggaggcctggtccagcctgagggat ccctgacactcacctgcacagcctctggattctcctttagtagtgatta ctggatatgctgggtccgccaggctccagggaagggcctggagtggatc ggatgcattcgtgatggtggtgggagttactacgcgaactgggcgaaag gccgactcaccatctccatgacctcgtcgaccacggtgggtctgaaaat gaccagtctgacagccgcggacacggccacgtattttttgtgcgagcgat attaatgatgggtggcttggccaattcaacttgtggggcccagggaccc tcgtcaccgtctcgagc.
```

In another embodiment of the invention, polynucleotides of the invention comprise, or alternatively consist of, the following polynucleotide sequence encoding the constant heavy chain polypeptide sequence of SEQ ID NO: 610:

```
                                        (SEQ ID NO: 620)
gcctccaccaagggcccatcggtcttccccctggcaccctcctccaaga gcacctctggggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctgggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg
```

-continued
ctgaatggcaaggagtacaagtgcaaggtctccaacaaagccctcccag ccccatcgagaaaaccatctccaaagccaaagggcagcccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 621:

(SEQ ID NO: 631)
gctgacattgtgatgacccagactccagcctccgtggaggcagctgtgg gaggcacagtcaccatcaagtgccaggccagtcagagcattagtagcta cttagcctggtatcagcagaaaccagggcagcctcccaagctcctgatc tacagggcatccactctggcctctggggtcccatcgcggttcagcggca gtggatctgggacagagttcactctcaccatcagcgacctggagtgtgc cgatgctgccacttactactgtcaaagctattattccgttactactgtt acttatggaaatactttcggcggagggaccgaggtggtggtcaaacgta cggtagcggccccatctgtcttcatcttcccgccatctgatgagcagtt gaaatctggaactgcctctgttgtgcctgctgaataacttctatccc agagaggccaaagtacagtggaaggtggataacgccctccaatcggta actcccaggagagtgtcacagagcaggacagcaaggacagcacctacag cctcagcagcaccctgacgctgagcaaagcagactacgagaaacacaaa gtctacgcctgcgaagtcacccatcagggcctgagctcgcccgtcacaa agagcttcaacaggggagagtgt.

In another embodiment of the invention, polynucleotides of the invention comprise, or alternatively consist of, the following polynucleotide sequence encoding the variable light chain polypeptide sequence of SEQ ID NO: 622:

(SEQ ID NO: 632)
gctgacattgtgatgacccagactccagcctccgtggaggcagctgtgg gaggcacagtcaccatcaagtgccaggccagtcagagcattagtagcta cttagcctggtatcagcagaaaccagggcagcctcccaagctcctgatc tacagggcatccactctggcctctggggtcccatcgcggttcagcggca gtggatctgggacagagttcactctcaccatcagcgacctggagtgtgc cgatgctgccacttactactgtcaaagctattattccgttactactgtt acttatggaaatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 630:

(SEQ ID NO: 640)
cgtacggtagcggccccatctgtcttcatcttcccgccatctgatgagc agttgaaatctggaactgcctctgttgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 614; SEQ ID NO: 616; and SEQ ID NO: 618, which correspond to polynucleotides encoding the complementarity-determining regions (CDRs, or hypervariable regions) of the heavy chain sequence of SEQ ID NO: 601 or the variable heavy chain sequence of SEQ ID NO: 602, and/or one or more of the polynucleotide sequences of SEQ ID NO: 634; SEQ ID NO: 636; and SEQ ID NO: 638, which correspond to the complementarity-determining regions (CDRs, or hypervariable regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 613; SEQ ID NO: 615; SEQ ID NO: 617; and SEQ ID NO: 619, which correspond to polynucleotides encoding the framework regions (FRs or constant regions) of the heavy chain sequence of SEQ ID NO: 601 or the variable heavy chain sequence of SEQ ID NO: 602, and/or one or more of the polynucleotide sequences of SEQ ID NO: 633; SEQ ID NO: 635; SEQ ID NO: 637; and SEQ ID NO: 639, which correspond to the framework regions (FRs or constant regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 611 encoding the heavy chain sequence of SEQ ID NO: 601; the polynucleotide SEQ ID NO: 612 encoding the variable heavy chain sequence of SEQ ID NO: 602; the polynucleotide SEQ ID NO: 631 encoding the light chain sequence of SEQ ID NO:

621; the polynucleotide SEQ ID NO: 632 encoding the variable light chain sequence of SEQ ID NO: 622; polynucleotides encoding the complementarity-determining regions (SEQ ID NO: 614; SEQ ID NO: 616; and SEQ ID NO: 618) of the heavy chain sequence of SEQ ID NO: 601 or the variable heavy chain sequence of SEQ ID NO: 602; polynucleotides encoding the complementarity-determining regions (SEQ ID NO: 634; SEQ ID NO: 636; and SEQ ID NO: 638) of the light chain sequence of SEQ ID NO: 621 or the variable light chain sequence of SEQ ID NO: 622; polynucleotides encoding the framework regions (SEQ ID NO: 613; SEQ ID NO: 615; SEQ ID NO: 617; and SEQ ID NO: 619) of the heavy chain sequence of SEQ ID NO: 601 or the variable heavy chain sequence of SEQ ID NO: 602; and polynucleotides encoding the framework regions (SEQ ID NO: 633; SEQ ID NO: 635; SEQ ID NO: 637; and SEQ ID NO: 639) of the light chain sequence of SEQ ID NO: 621 or the variable light chain sequence of SEQ ID NO: 622.

In a preferred embodiment of the invention, polynucleotides of the invention comprise, or alternatively consist of, polynucleotides encoding Fab (fragment antigen binding) fragments having binding specificity for PCSK9. With respect to antibody Ab16, the polynucleotides encoding the full length Ab16 antibody comprise, or alternatively consist of, the polynucleotide SEQ ID NO: 611 encoding the heavy chain sequence of SEQ ID NO: 601 and the polynucleotide SEQ ID NO: 631 encoding the light chain sequence of SEQ ID NO: 621.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab16 following expression of the full-length polynucleotides in a suitable host. In another embodiment of the invention, anti-PCSK9 antibodies such as Ab16 or Fab fragments thereof may be produced via expression of Ab16 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab17

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 641:

(SEQ ID NO: 651)
caggagcagctggaggagtccggggagacctggtcaagcctgagggat ccctgacactcacctgcacagcctctggattctccttcagtagcagcta ctggatatgctgggtccgccaggctccagggaagggactggagtggatc ggatgcattcgtcctggtagtgcggattactacgcgagctgggcgaaag gccgattcaccatctccagagcctcgtcgtccacggtgactctgcaaat gaccagtctgacagccgcggacacggccacctattttttgtgcgagcgat attaatgatgggtggcttggccaattcaacttgtggggcccaggcaccc tggtcaccgtctcgagcgcctccaccaagggcccatcggtcttccccct ggcaccctcctccaagagcacctctgggggcacagcggccctgggctgc ctggtcaaggactacttccccgaaccggtgacggtgtcgtggaactcag gcgccctgaccagcggcgtgcacaccttcccggctgtcctacagtcctc aggactctactccctcagcagcgtggtgaccgtgccctccagcagcttg ggcacccagacctacatctgcaacgtgaatcacaagcccagcaacacca aggtggacaagagagttgagcccaaatcttgtgacaaaactcacacatg cccaccgtgcccagcacctgaactcctggggggaccgtcagtcttcctc ttccccccaaaacccaaggacaccctcatgatctcccggacccctgagg tcacatgcgtggtggtggacgtgagccacgaagaccctgaggtcaagtt caactggtacgtggacggcgtggaggtgcataatgccaagacaaagccg cgggaggagcagtacgccagcacgtaccgtgtggtcagcgtcctcaccg tcctgcaccaggactggctgaatggcaaggagtacaagtgcaaggtctc caacaaagcctcccagccccatcgagaaaaccatctccaaagccaaa gggcagccccgagaaccacaggtgtacaccctgcccccatcccgggagg agatgaccaagaaccaggtcagcctgacctgcctggtcaaaggcttcta tcccagcgacatcgccgtggagtgggagagcaatgggcagccggagaac aactacaagaccacgcctcccgtgctggactccgacggctccttcttcc tctacagcaagctcaccgtggacaagagcaggtggcagcaggggaacgt cttctcatgctccgtgatgcatgaggctctgcacaaccactacacgcag aagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 642:

(SEQ ID NO: 652)
caggagcagctggaggagtccggggagacctggtcaagcctgagggat ccctgacactcacctgcacagcctctggattctccttcagtagcagcta ctggatatgctgggtccgccaggctccagggaagggactggagtggatc ggatgcattcgtcctggtagtgcggattactacgcgagctgggcgaaag gccgattcaccatctccagagcctcgtcgtccacggtgactctgcaaat gaccagtctgacagccgcggacacggccacctattttttgtgcgagcgat attaatgatgggtggcttggccaattcaacttgtggggcccaggcaccc tggtcaccgtctcgagc.

In another embodiment of the invention, polynucleotides of the invention comprise, or alternatively consist of, the following polynucleotide sequence encoding the constant heavy chain polypeptide sequence of SEQ ID NO: 650:

(SEQ ID NO: 660)
gcctccaccaagggcccatcggtcttccccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgccaccgtgcccagcac ctgaactcctgggggaccgtcagtcttcctcttcccccaaaacccaa ggacaccctcatgatctcccggacccctgaggtcacatgcgtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 661:

(SEQ ID NO: 671)
gccgatgttgtgatgacccagactccagcctccgtggaggcagctgtggg aggcacagtcaccatcaagtgccaggccagtctgagcattgctgactact tagcctggtatctccagaaaccagggcagcctcccaagctcctgatctac agggcatccactctggcatctggggtcccatcgcggttcaagggcagtgg atctgggacagagtacactctcaccatcagcgacctggagtgtgccgatg ctgccacttactactgtcaaagctattattccgttactactaatacttat ggaaatactttcggcggagggaccgaggtggtggtcaaacgtacggtagc ggccccatctgtcttcatcttcccgccatctgatgagcagttgaaatctg gaactgcctctgttgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 662:

(SEQ ID NO: 672)
gccgatgttgtgatgacccagactccagcctccgtggaggcagctgtggg aggcacagtcaccatcaagtgccaggccagtctgagcattgctgactact tagcctggtatctccagaaaccagggcagcctcccaagctcctgatctac agggcatccactctggcatctggggtcccatcgcggttcaagggcagtgg atctgggacagagtacactctcaccatcagcgacctggagtgtgccgatg ctgccacttactactgtcaaagctattattccgttactactaatacttat ggaaatactttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 670:

(SEQ ID NO: 680)
cgtacggtagcggccccatctgtcttcatcttcccgccatctgatgagca gttgaaatctggaactgcctctgttgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 654; SEQ ID NO: 656; and SEQ ID NO: 658, which correspond to polynucleotides encoding the complementarity-determining regions (CDRs, or hypervariable regions) of the heavy chain sequence of SEQ ID NO: 641 or the variable heavy chain sequence of SEQ ID NO: 642, and/or one or more of the polynucleotide sequences of SEQ ID NO: 674; SEQ ID NO: 676; and SEQ ID NO: 678, which correspond to the complementarity-determining regions (CDRs, or hypervariable regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 653; SEQ ID NO: 655; SEQ ID NO: 657; and SEQ ID NO: 659, which correspond to polynucleotides encoding the framework regions (FRs or constant regions) of the heavy chain sequence of SEQ ID NO: 641 or the variable heavy chain sequence of SEQ ID NO: 642, and/or one or more of the polynucleotide sequences of SEQ ID NO: 673; SEQ ID NO: 675; SEQ ID NO: 677; and SEQ ID NO: 679, which correspond to the framework regions (FRs or constant regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 651 encoding the heavy chain sequence of SEQ ID NO: 641; the polynucleotide SEQ ID NO: 652 encoding the variable heavy chain sequence of SEQ ID NO: 642; the polynucleotide SEQ ID NO: 671 encoding the light chain sequence of SEQ ID NO: 661; the polynucleotide SEQ ID NO: 672 encoding the variable light chain sequence of SEQ ID NO: 662; polynucleotides encoding the complementarity-determining regions (SEQ ID NO: 654; SEQ ID NO: 656; and SEQ ID NO: 658) of the heavy chain sequence of SEQ ID NO: 641 or the variable heavy chain sequence of SEQ ID NO: 642; polynucleotides encoding the complementarity-determining regions (SEQ ID NO: 674; SEQ ID NO: 676; and SEQ ID NO: 678) of the light chain sequence of SEQ ID NO: 661 or the variable light chain sequence of SEQ ID NO: 662; polynucleotides encoding the framework regions (SEQ ID NO: 653; SEQ ID NO: 655; SEQ ID NO: 657; and SEQ ID NO: 659) of the heavy chain sequence of SEQ ID NO: 641 or the variable heavy chain sequence of SEQ ID NO: 642; and polynucleotides encoding the framework regions (SEQ ID NO: 673; SEQ ID NO: 675; SEQ ID NO: 677; and SEQ ID NO: 679) of the light chain sequence of SEQ ID NO: 661 or the variable light chain sequence of SEQ ID NO: 662.

In a preferred embodiment of the invention, polynucleotides of the invention comprise, or alternatively consist of, polynucleotides encoding Fab (fragment antigen binding) fragments having binding specificity for PCSK9. With respect to antibody Ab17, the polynucleotides encoding the full length Ab17 antibody comprise, or alternatively consist of, the polynucleotide SEQ ID NO: 651 encoding the heavy chain sequence of SEQ ID NO: 641 and the polynucleotide SEQ ID NO: 671 encoding the light chain sequence of SEQ ID NO: 661.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab17 following expression of the full-length polynucleotides in a suitable host. In another embodiment of the invention, anti-PCSK9 antibodies such as Ab17 or Fab fragments thereof may be produced via expression of Ab17 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab18

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 681:

(SEQ ID NO: 691)
gaggtgcagcttgtggagtctgggggaggcttggtccagcctgggggtc cctgagactctcctgtgcagcctctggattcaccgtcagtagcaactact ggatatgctgggtccgtcaggctccagggaaggggctggagtggatcgga tgcattcgtgatggtggtggcacttactacgctagctctgctaaaggccg attcaccatctccagagacaattccaagaacaccctgtatcttcaaatga acagcctgagagctgaggacactgctgtgtattactgtgctagcgatatc aatgatgggtggcttggccaattcaacttgtggggccaagggaccctcgt caccgtctcgagcgcctccaccaagggcccatcggtcttccccctggcac cctcctccaagagcacctctgggggcacagcggccctgggctgcctggtc aaggactacttcccgaaccggtgacggtgtcgtggaactcaggcgccct gaccagcggcgtgcacaccttcccggctgtcctacagtcctcaggactct actccctcagcagcgtggtgaccgtgccctccagcagcttgggcacccag acctacatctgcaacgtgaatcacaagcccagcaacaccaaggtggacgc gagagttgagcccaaatcttgtgacaaaactcacacatgcccaccgtgcc cagcacctgaactcctgggggaccgtcagtcttcctcttcccccccaaaa cccaaggacaccctcatgatctcccggacccctgaggtcacatgcgtggt ggtggacgtgagccacgaagaccctgaggtcaagttcaactggtacgtgg acggcgtggaggtgcataatgccaagacaaagccgcgggaggagcagtac gccagcacgtaccgtgtggtcagcgtcctcaccgtcctgcaccaggactg gctgaatggcaaggagtacaagtgcaaggtctccaacaaagccctcccag cccccatcgagaaaaccatctccaaagccaaagggcagccccgagaacca caggtgtacaccctgcccccatcccgggaggagatgaccaagaaccaggt cagcctgacctgcctggtcaaaggcttctatcccagcgacatcgccgtgg agtgggagagcaatgggcagccggagaacaactacaagaccacgcctccc gtgctggactccgacggctccttcttcctctacagcaagctcaccgtgga caagagcaggtggcagcaggggaacgtcttctcatgctccgtgatgcatg aggctctgcacaaccactacacgcagaagagcctctccctgtctccgggt aaa.

In another embodiment of the invention, the polynucleotides of the invention comprise, or alternatively consist of, the following polynucleotide sequence encoding the variable heavy chain polypeptide sequence of SEQ ID NO: 682: gaggtgcagcttgtggagtctgggggaggct-tggtccagcctgggggtccctgagactctcctgtgcagcctctggattcaccgt cagtagcaactactggatatgctgggtc-cgtcaggctccagggaaggggctg-gagtggatcggatgcattcgtgatggtggtggc acttactacgctagctct-gctaaaggccgattcaccatctccagagacaattccaagaacaccctgtatcttc aaatgaacagcctga gagctgaggacactgctgtgtattact-gtgctagcgatatcaatgatgggtggct-tggccaattcaacttgtggggccaagggaccc tcgtcaccgtctcgagc (SEQ ID NO: 692).

In another embodiment of the invention, polynucleotides of the invention comprise, or alternatively consist of, the following polynucleotide sequence encoding the constant heavy chain polypeptide sequence of SEQ ID NO: 690:

(SEQ ID NO: 700)
gcctccaccaagggcccatcggtcttcccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 701:

(SEQ ID NO: 711)
gctgacattgtgatgacccagtctccatcctccctgtctgcatctgtagg agacagagtcaccatcaagtgccaggccagtcagagcattagtgcttact tagcctggtatcagcagaaaccagggaaagtccctaagctcctgatctat agggcatacactctggcatctggggtcccatctcgtttcagtggcagtgg atctgggacagatttcactctcaccatcagcagcctgcagcctgaagatg ttgcaacttattactgtcaaagctactattccgttactactaatacttat ggaaatactttcggcggaggaaccaaggtggaaatcaaacgtacggtggc tgcaccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.

In another embodiment of the invention, polynucleotides of the invention comprise, or alternatively consist of, the following polynucleotide sequence encoding the variable light chain polypeptide sequence of SEQ ID NO: 702:

(SEQ ID NO: 712)
gctgacattgtgatgacccagtctccatcctccctgtctgcatctgtagg agacagagtcaccatcaagtgccaggccagtcagagcattagtgcttact tagcctggtatcagcagaaaccagggaaagtccctaagctcctgatctat agggcatacactctggcatctggggtcccatctcgtttcagtggcagtgg atctgggacagatttcactctcaccatcagcagcctgcagcctgaagatg ttgcaacttattactgtcaaagctactattccgttactactaatacttat ggaaatactttcggcggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 710:

(SEQ ID NO: 720)
cgtacggtggctgcaccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 694; SEQ ID NO: 696; and SEQ ID NO: 698, which correspond to polynucleotides encoding the complementarity-determining regions (CDRs, or hypervariable regions) of the heavy chain sequence of SEQ ID NO: 681 or the variable heavy chain sequence of SEQ ID NO: 682, and/or one or more of the polynucleotide sequences of SEQ ID NO: 714; SEQ ID NO: 716; and SEQ ID NO: 718, which correspond to the complementarity-determining regions (CDRs, or hypervariable regions) of the light chain sequence of SEQ ID NO: 701 or the variable light chain sequence of SEQ ID NO: 702, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 693; SEQ ID NO: 695; SEQ ID NO: 697; and SEQ ID NO: 699, which correspond to polynucleotides encoding the framework regions (FRs or constant regions) of the heavy chain sequence of SEQ ID NO: 681 or the variable heavy chain sequence of SEQ ID NO: 682, and/or one or more of the polynucleotide sequences of SEQ ID NO: 713; SEQ ID NO: 715; SEQ ID NO: 717; and SEQ ID NO: 719, which correspond to the framework regions (FRs or constant regions) of the light chain sequence of SEQ ID NO: 701 or the variable light chain sequence of SEQ ID NO: 702, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 691 encoding the heavy chain sequence of SEQ ID NO: 681; the polynucleotide SEQ ID NO: 692 encoding the variable heavy chain sequence of SEQ ID NO: 682; the polynucleotide SEQ ID NO: 711 encoding the light chain sequence of SEQ ID NO: 701; the polynucleotide SEQ ID NO: 712 encoding the variable light chain sequence of SEQ ID NO: 702; polynucleotides encoding the complementarity-determining regions (SEQ ID NO: 694; SEQ ID NO: 696; and SEQ ID NO: 698) of the heavy chain sequence of SEQ ID NO: 681 or the variable heavy chain sequence of SEQ ID NO: 682; polynucleotides encoding the complementarity-determining regions (SEQ ID NO: 714; SEQ ID NO: 716; and SEQ ID NO: 718) of the light chain sequence of SEQ ID NO: 701 or the variable light chain sequence of SEQ ID NO: 702; polynucleotides encoding the framework regions (SEQ ID NO: 693; SEQ ID NO: 695; SEQ ID NO: 697; and SEQ ID NO: 699) of the heavy chain sequence of SEQ ID NO: 681 or the variable heavy chain sequence of SEQ ID NO: 682; and polynucleotides encoding the framework regions (SEQ ID NO: 713; SEQ ID NO: 715; SEQ ID NO: 717; and SEQ ID NO: 719) of the light chain sequence of SEQ ID NO: 701 or the variable light chain sequence of SEQ ID NO: 702.

In a preferred embodiment of the invention, polynucleotides of the invention comprise, or alternatively consist of, polynucleotides encoding Fab (fragment antigen binding) fragments having binding specificity for PCSK9. With respect to antibody Ab18, the polynucleotides encoding the full length Ab18 antibody comprise, or alternatively consist of, the polynucleotide SEQ ID NO: 691 encoding the heavy chain sequence of SEQ ID NO: 681 and the polynucleotide SEQ ID NO: 711 encoding the light chain sequence of SEQ ID NO: 701.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab18 following expression of the full-length polynucleotides in a suitable host. In another embodiment of the invention, anti-PCSK9 antibodies such as Ab18 or Fab fragments thereof may be produced via expression of Ab18 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab19

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 721:

(SEQ ID NO: 731)
gaggtgcagcttgtggagtctgggggaggcttggtccagcctgggggtc cctgagactctcctgtgcagcctctggaatcgacctcagtagctatgcaa tgggctgggtccgtcaggctccagggaaggggctggagtacatcggaatc attgttagttatgggcccacatactacgctagctgggctaaaggccgatt caccatctccagagacaattccaagaacaccgtgtatcttcaaatgaaca gcctgagagctgaggacactgccacctatttctgtgccagagatctggat gctcaaagtagtggttactatggagcttttaacatctggggccaagggac cctcgtcaccgtctcgagcgcctccaccaagggcccatcggtcttcccc tggcacctcctccaagagcacctctggggcacagcggccctgggctgc ctggtcaaggactacttccccgaaccggtgacggtgtcgtggaactcagg cgcctgaccagcggcgtgcacaccttcccggctgtcctacagtcctcag gactctactccctcagcagcgtggtgaccgtgccctccagcagcttgggc acccagacctacatctgcaacgtgaatcacaagcccagcaacaccaaggt ggacaagagagttgagcccaaatcttgtgacaaaactcacacatgcccac cgtgcccagcacctgaactcctggggggaccgtcagtcttcctcttcccc ccaaaacccaaggacaccctcatgatctcccggacccctgaggtcacatg cgtggtggtggacgtgagccacgaagaccctgaggtcaagttcaactggt acgtggacggcgtggaggtgcataatgccaagacaaagccgcgggaggag cagtacgccagcacgtaccgtgtggtcagcgtcctcaccgtcctgcacca ggactggctgaatggcaaggagtacaagtgcaaggtctccaacaaagccc tcccagcccccatcgagaaaaccatctccaaagccaaagggcagcccga gaaccacaggtgtacaccctgcccccatcccgggaggagatgaccaagaa ccaggtcagcctgacctgcctggtcaaaggcttctatcccagcgacatcg ccgtggagtgggagagcaatgggcagccggagaacaactacaagaccacg cctcccgtgctggactccgacggctccttcttcctctacagcaagctcac cgtggacaagagcaggtggcagcagggggaacgtcttctcatgctccgtga tgcatgaggctctgcacaaccactacacgcagaagagcctctccctgtct ccgggtaaa.

In another embodiment of the invention, the polynucleotides of the invention comprise, or alternatively consist of, the following polynucleotide sequence encoding the variable heavy chain polypeptide sequence of SEQ ID NO: 722:

(SEQ ID NO: 732)
gaggtgcagcttgtggagtctgggggaggcttggtccagcctgggggtc cctgagactctcctgtgcagcctctggaatcgacctcagtagctatgcaa tgggctgggtccgtcaggctccagggaaggggctggagtacatcggaatc attgttagttatgggcccacatactacgctagctgggctaaaggccgatt caccatctccagagacaattccaagaacaccgtgtatcttcaaatgaaca gcctgagagctgaggacactgccacctatttctgtgccagagatctggat In another embodiment of the invention, polynucleotides of the invention comprise, or alternatively consist of, the following polynucleotide sequence encoding the constant heavy chain polypeptide sequence of SEQ ID NO: 730:

(SEQ ID NO: 740)
gcctccaccaagggcccatcggtcttccccctggcaccctcctccaagag
cacctctgggggcacagcggccctgggctgcctggtcaaggactacttcc
ccgaaccggtgacggtgtcgtggaactcaggcgccctgaccagcggcgtg
cacaccttcccggctgtcctacagtcctcaggactctactccctcagcag
cgtggtgaccgtgccctccagcagcttgggcacccagacctacatctgca
acgtgaatcacaagcccagcaacaccaaggtggacaagagagttgagccc
aaatcttgtgacaaaactcacacatgcccaccgtgcccagcacctgaact
cctggggggaccgtcagtcttcctcttccccccaaaacccaaggacaccc
tcatgatctcccggacccctgaggtcacatgcgtggtggtggacgtgagc
cacgaagaccctgaggtcaagttcaactggtacgtggacggcgtggaggt
gcataatgccaagacaaagccgcgggaggagcagtacgccagcacgtacc
gtgtggtcagcgtcctcaccgtcctgcaccaggactggctgaatggcaag
gagtacaagtgcaaggtctccaacaaagcctcccagcccccatcgagaa
aaccatctccaaagccaaagggcagccccgagaaccacaggtgtacaccc
tgcccccatcccgggaggagatgaccaagaaccaggtcagcctgacctgc
ctggtcaaaggcttctatcccagcgacatcgccgtggagtgggagagcaa
tgggcagccggagaacaactacaagaccacgcctcccgtgctggactccg
acggctccttcttcctctacagcaagctcaccgtggacaagagcaggtgg
cagcaggggaacgtcttctcatgctccgtgatgcatgaggctctgcacaa
ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 741:

(SEQ ID NO: 751)
gacatccagatgacccagtctccttccaccctgtctgcatctgtaggaga
cagagtcaccatcacttgtcaggccagtcagagcattagcactgcattag
cctggtatcagcagaaaccaggaaaagcccctaagctcctgatctatgct
gcatccctctggcatctggagtcccatcaaggttcagcggcagtggatc
tggaacagaattcactctcaccatcagcagcctgcagcctgatgattttg
caacttactactgtcaaagctattatggtagtagcaacattgctttcggc
ggaggaaccaaggtggaaatcaaacgtacggtggctgcaccatctgtctt
catcttcccgccatctgatgagcagttgaaatctggaactgcctctgttg
tgtgcctgctgaataacttctatcccagagaggccaaagtacagtggaag
gtggataacgccctccaatcgggtaactcccaggagagtgtcacagagca
ggacagcaaggacagcacctacagcctcagcagcaccctgacgctgagca
aagcagactacgagaaacacaaagtctacgcctgcgaagtcacccatcag
ggcctgagctcgcccgtcacaaagagcttcaacaggggagagtgt.

In another embodiment of the invention, polynucleotides of the invention comprise, or alternatively consist of, the following polynucleotide sequence encoding the variable light chain polypeptide sequence of SEQ ID NO: 742:

(SEQ ID NO: 752)
gacatccagatgacccagtctccttccaccctgtctgcatctgtaggaga
cagagtcaccatcacttgtcaggccagtcagagcattagcactgcattag
cctggtatcagcagaaaccaggaaaagcccctaagctcctgatctatgct
gcatccctctggcatctggagtcccatcaaggttcagcggcagtggatc
tggaacagaattcactctcaccatcagcagcctgcagcctgatgattttg
caacttactactgtcaaagctattatggtagtagcaacattgctttcggc
ggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 750:

(SEQ ID NO: 760)
cgtacggtggctgcaccatctgtcttcatcttcccgccatctgatgagca
gttgaaatctggaactgcctctgttgtgtgcctgctgaataacttctatc
ccagagaggccaaagtacagtggaaggtggataacgccctccaatcgggt
aactcccaggagagtgtcacagagcaggacagcaaggacagcacctacag
cctcagcagcaccctgacgctgagcaaagcagactacgagaaacacaaag
tctacgcctgcgaagtcacccatcagggcctgagctcgcccgtcacaaag
agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 734; SEQ ID NO: 736; and SEQ ID NO: 738, which correspond to polynucleotides encoding the complementarity-determining regions (CDRs, or hypervariable regions) of the heavy chain sequence of SEQ ID NO: 721 or the variable heavy chain sequence of SEQ ID NO: 722, and/or one or more of the polynucleotide sequences of SEQ ID NO: 754; SEQ ID NO: 756; and SEQ ID NO: 758, which correspond to the complementarity-determining regions (CDRs, or hypervariable regions) of the light chain sequence of SEQ ID NO: 741 or the variable light chain sequence of SEQ ID NO: 742, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 733; SEQ ID NO: 735; SEQ ID NO: 737; and SEQ ID NO: 739, which correspond to polynucleotides encoding the framework regions (FRs or constant regions) of the heavy chain sequence of SEQ ID NO: 721 or the variable heavy chain sequence of SEQ ID NO: 722, and/or one or more of the polynucleotide sequences of SEQ ID NO: 753; SEQ ID NO: 755; SEQ ID NO: 757; and SEQ ID NO: 759, which correspond to the framework regions (FRs or constant regions) of the light chain sequence of SEQ ID NO: 741 or the variable light chain sequence of SEQ ID NO: 742, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 731 encoding the heavy chain sequence of SEQ ID NO: 721; the polynucleotide SEQ ID NO: 732 encoding the variable heavy chain sequence of SEQ ID NO: 722; the polynucleotide SEQ ID NO: 751 encoding the light chain sequence of SEQ ID NO: 741; the polynucleotide SEQ ID NO: 752 encoding the variable light chain sequence of SEQ ID NO: 742; polynucleotides encoding the complementarity-determining regions (SEQ ID NO: 734; SEQ ID NO: 736; and SEQ ID NO: 738) of the heavy chain sequence of SEQ ID NO: 721 or the variable heavy chain sequence of SEQ ID NO: 722; polynucleotides encoding the complementarity-determining regions (SEQ ID NO: 754; SEQ ID NO: 756; and SEQ ID NO: 758) of the light chain sequence of SEQ ID NO: 741 or the variable light chain sequence of SEQ ID NO: 742; polynucleotides encoding the framework regions (SEQ ID NO: 733; SEQ ID NO: 735; SEQ ID NO: 737; and SEQ ID NO: 739) of the heavy chain sequence of SEQ ID NO: 721 or the variable heavy chain sequence of SEQ ID NO: 722; and polynucleotides encoding the framework regions (SEQ ID NO: 753; SEQ ID NO: 755; SEQ ID NO: 757; and SEQ ID NO: 759) of the light chain sequence of SEQ ID NO: 741 or the variable light chain sequence of SEQ ID NO: 742.

In a preferred embodiment of the invention, polynucleotides of the invention comprise, or alternatively consist of, polynucleotides encoding Fab (fragment antigen binding) fragments having binding specificity for PCSK9. With respect to antibody Ab19, the polynucleotides encoding the full length Ab19 antibody comprise, or alternatively consist of, the polynucleotide SEQ ID NO: 731 encoding the heavy chain sequence of SEQ ID NO: 721 and the polynucleotide SEQ ID NO: 751 encoding the light chain sequence of SEQ ID NO: 741.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab19 following expression of the full-length polynucleotides in a suitable host. In another embodiment of the invention, anti-PCSK9 antibodies such as Ab19 or Fab fragments thereof may be produced via expression of Ab19 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab20

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 761:

(SEQ ID NO: 771)
gaggtgcagcttgtggagtctgggggaggcttggtccagcctggggggtc cctgagactctcctgtgcagcctctggaatcgacctcagtagctatgcaa tgggctgggtccgtcaggctccagggaaggggctggagtacatcggaatc attgttagttatgggcccacatactacgctagctgggctaaaggccgatt caccatctccagagacaattccaagtccaccgtgtatcttcaaatgaaca gcctgagagctgaggacactgccacctatttctgtgccagagatctggat gctcaaagtagtggttactatggagcttttaacatctggggccaagggac cctcgtcaccgtctcgagcgcctccaccaagggcccatcggtcttcccc tggcacctcctccaagagcacctctgggggcacagcggccctgggctgc ctggtcaaggactacttccccgaaccggtgacggtgtcgtggaactcagg cgccctgaccagcggcgtgcacaccttcccggctgtcctacagtcctcag gactctactccctcagcagcgtggtgaccgtgccctccagcagcttgggc acccagacctacatctgcaacgtgaatcacaagcccagcaacaccaaggt ggacaagagagttgagcccaaatcttgtgacaaaactcacacatgcccac cgtgcccagcacctgaactcctgggggaccgtcagtcttcctcttcccc ccaaaacccaaggacaccctcatgatctcccggacccctgaggtcacatg cgtggtggtggacgtgagccacgaagaccctgaggtcaagttcaactggt acgtggacggcgtggaggtgcataatgccaagacaaagccgcgggaggag cagtacgccagcacgtaccgtgtggtcagcgtcctcaccgtcctgcacca ggactggctgaatggcaaggagtacaagtgcaaggtctccaacaaagccc tcccagcccccatcgagaaaaccatctccaaagccaaagggcagccccga gaaccacaggtgtacaccctgcccccatcccgggaggagatgaccaagaa ccaggtcagcctgacctgcctggtcaaaggcttctatcccagcgacatcg ccgtggagtgggagagcaatgggcagccggagaacaactacaagaccacg cctcccgtgctggactccgacggctccttcttcctctacagcaagctcac cgtggacaagagcaggtggcagcaggggaacgtcttctcatgctccgtga tgcatgaggctctgcacaaccactacacgcagaagagcctctccctgtct ccgggtaaa.

In another embodiment of the invention, the polynucleotides of the invention comprise, or alternatively consist of, the following polynucleotide sequence encoding the variable heavy chain polypeptide sequence of SEQ ID NO: 762:

(SEQ ID NO: 772)
gaggtgcagcttgtggagtctgggggaggcttggtccagcctgggggt ccctgagactctcctgtgcagcctctggaatcgacctcagtagctatgc aatgggctgggtccgtcaggctccagggaaggggctggagtacatcgga atcattgttagttatgggcccacatactacgctagctgggctaaaggcc gattcaccatctccagagacaattccaagtccaccgtgtatcttcaaat gaacagcctgagagctgaggacactgccacctatttctgtgccagagat ctggatgctcaaagtagtggttactatggagcttttaacatctgggcc aagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 770:

(SEQ ID NO: 780)
gcctccaccaagggcccatcggtcttccccctggcacctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgcctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 781:

(SEQ ID NO: 791)
gacatccagatgacccagtctccttccaccctgtctgcatctgtaggag acagagtcaccatcacttgtcaggccagtcagagcattagcactgcatt agcctggtatcagcagaaaccaggaaaagcccctaagctcctgatctat gctgcatccctctggcatctggagtcccatcaaggttcagcggcagtg gatctggaacagaattcactctcaccatcagcagcctgcagcctgatga ttttgcaacttactactgtcaaagctattatggtagtagcaacattgct ttcggcggaggaaccaaggtggaaatcaaacgtacggtggctgcaccat ctgtcttcatcttcccgccatctgatgagcagttgaaatctggaactgc ctctgttgtgtgcctgctgaataacttctatcccagagaggccaaagta cagtggaaggtggataacgccctccaatcgggtaactcccaggagagtg tcacagagcaggacagcaaggacagcacctacgcctcagcagcaccct gacgctgagcaaagcagactacgagaaacacaaagtctacgcctgcgaa gtcacccatcagggcctgagctcgcccgtcacaaagagcttcaacaggg gagagtgt.

In another embodiment of the invention, polynucleotides of the invention comprise, or alternatively consist of, the following polynucleotide sequence encoding the variable light chain polypeptide sequence of SEQ ID NO: 782:

(SEQ ID NO: 792)
gacatccagatgacccagtctccttccaccctgtctgcatctgtaggag acagagtcaccatcacttgtcaggccagtcagagcattagcactgcatt agcctggtatcagcagaaaccaggaaaagcccctaagctcctgatctat gctgcatccctctggcatctggagtcccatcaaggttcagcggcagtg gatctggaacagaattcactctcaccatcagcagcctgcagcctgatga ttttgcaacttactactgtcaaagctattatggtagtagcaacattgct ttcggcggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 790:

(SEQ ID NO: 800)
cgtacggtggctgcaccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaagtctacgcctgcgaagtcacccatcagggcctgagctcgcccgtc acaaagagcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 774; SEQ ID NO: 776; and SEQ ID NO: 778, which correspond to polynucleotides encoding the complementarity-determining regions (CDRs, or hypervariable regions) of the heavy chain sequence of SEQ ID NO: 761 or the variable heavy chain sequence of SEQ ID NO: 762, and/or one or more of the polynucleotide sequences of SEQ ID NO: 794; SEQ ID NO: 796; and SEQ ID NO: 798, which correspond to the complementarity-determining regions (CDRs, or hypervariable regions) of the light chain sequence of SEQ ID NO: 781 or the variable light chain sequence of SEQ ID NO: 782, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 773; SEQ ID NO: 775; SEQ ID NO: 777; and SEQ ID NO: 779, which correspond to polynucleotides encoding the framework regions (FRs or constant regions) of the heavy chain sequence of SEQ ID NO: 761 or the variable heavy chain sequence of SEQ ID NO: 762, and/or one or more of the polynucleotide sequences of SEQ ID NO: 793; SEQ ID NO: 795; SEQ ID NO: 797; and SEQ ID NO: 799, which correspond to the framework regions (FRs or constant regions) of the light chain sequence of SEQ ID NO: 781 or the variable light chain sequence of SEQ ID NO: 782, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 771 encoding the heavy chain sequence of SEQ ID NO: 761; the polynucleotide SEQ ID NO: 772 encoding the variable heavy chain sequence of SEQ ID NO: 762; the polynucleotide SEQ ID NO: 791 encoding the light chain sequence of SEQ ID NO: 781; the polynucleotide SEQ ID NO: 792 encoding the variable light chain sequence of SEQ ID NO: 782; polynucleotides encoding the complementarity-determining regions (SEQ ID NO: 774; SEQ ID NO: 776; and SEQ ID NO: 778) of the heavy chain sequence of SEQ ID NO: 761 or the variable heavy chain sequence of SEQ ID NO: 762; polynucleotides encoding the complementarity-determining regions (SEQ ID NO: 794; SEQ ID NO: 796; and SEQ ID NO: 798) of the light chain sequence of SEQ ID NO: 781 or the variable light chain sequence of SEQ ID NO: 782; polynucleotides encoding the framework regions (SEQ ID NO: 773; SEQ ID NO: 775; SEQ ID NO: 777; and SEQ ID NO: 779) of the heavy chain sequence of SEQ ID NO: 761 or the variable heavy chain sequence of SEQ ID NO: 762; and polynucleotides encoding the framework regions (SEQ ID NO: 793; SEQ ID NO: 795; SEQ ID NO: 797; and SEQ ID NO: 799) of the light chain sequence of SEQ ID NO: 781 or the variable light chain sequence of SEQ ID NO: 782.

In a preferred embodiment of the invention, polynucleotides of the invention comprise, or alternatively consist of, polynucleotides encoding Fab (fragment antigen binding) fragments having binding specificity for PCSK9. With respect to antibody Ab20, the polynucleotides encoding the full length Ab20 antibody comprise, or alternatively consist of, the polynucleotide SEQ ID NO: 771 encoding the heavy chain sequence of SEQ ID NO: 761 and the polynucleotide SEQ ID NO: 791 encoding the light chain sequence of SEQ ID NO: 781.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab20 following expression of the full-length polynucleotides in a suitable host. In another embodiment of the invention, anti-PCSK9 antibodies such as Ab20 or Fab fragments thereof may be produced via expression of Ab20 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab21

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 801:

```
                                    (SEQ ID NO: 811)
cagtcggtggaggagtccgggggtcgcctggtcacgcctgggacacccc tgacactcacctgcacagtctctggattctccctcagtagttatgcaat gaattgggtccgccaggctccagggaagggctggagtggatcggggcc attcgtagtagtggtgccacattcttcgcgagctgggtgaatggccgtt tcaccatctccaaaacctcgaccacggtggatctgaaaatcaccagtcc gacacccgaggacacggccacctatttctgtgccagagatactaatgat ggttggtatattaatcggttggatctctggggcccgggcaccctcgtca ccgtctcgagcgcctccaccaagggcccatcggtcttcccctggcacc ctcctccaagagcacctctgggggcacagcggccctgggctgcctggtc aaggactacttccccgaaccggtgacggtgtcgtggaactcaggcgccc tgaccagcggcgtgcacaccttcccggctgtcctacagtcctcaggact ctactccctcagcagcgtggtgaccgtgccctccagcagcttgggcacc cagacctacatctgcaacgtgaatcacaagcccagcaacaccaaggtgg acaagagagttgagcccaaatcttgtgacaaaactcacacatgcccac cgtgcccagcacctgaactcctggggggaccgtcagtcttcctcttccc cccaaaacccaaggacaccctcatgatctcccggacccctgaggtcaca tgcgtggtggtggacgtgagccacgaagaccctgaggtcaagttcaact ggtacgtggacggcgtggaggtgcataatgccaagacaaagccgcggga ggagcagtacgccagcacgtaccgtgtggtcagcgtcctcaccgtcctg caccaggactggctgaatggcaaggagtacaagtgcaaggtctccaaca aagccctcccagccccatcgagaaaaccatctccaaagccaaagggca gccccgagaaccacaggtgtacaccctgcccccatcccgggaggagatg accaagaaccaggtcagcctgacctgcctggtcaaaggcttctatccca
``` gcgacatcgccgtggagtgggagagcaatgggcagccggagaacaacta caagaccacgcctcccgtgctggactccgacggctccttcttcctctac agcaagctcaccgtggacaagagcaggtggcagcaggggaacgtcttct catgctccgtgatgcatgaggctctgcacaaccactacacgcagaagag cctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 802:

(SEQ ID NO: 812)
cagtcggtggaggagtccgggggtcgcctggtcacgcctgggacacccc tgacactcacctgcacagtctctggattctccctcagtagttatgcaat gaattgggtccgccaggctccagggaaggggctggagtggatcgggggcc attcgtagtagtggtgccacattcttcgcgagctgggtaatggccgtt tcaccatctccaaaacctcgaccacggtggatctgaaaatcaccagtcc gacacccgaggacacggccacctatttctgtgccagagatactaatgat ggttggtatattaatcggttggatctctggggcccgggcaccctcgtca ccgtctcgagc.

In another embodiment of the invention, polynucleotides of the invention comprise, or alternatively consist of, the following polynucleotide sequence encoding the constant heavy chain polypeptide sequence of SEQ ID NO: 810:

(SEQ ID NO: 820)
gcctccaccaagggcccatcggtcttccccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagagagtt gagcccaaatcttgtgacaaaactcacacatgcccaccgtgcccagcac ctgaactcctggggggaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacgc cagcacgtaccgtgtggtcagcgtcctcaccgtcctgcaccaggactgg ctgaatggcaaggagtacaagtgcaaggtctccaacaaagccctcccag cccccatcgagaaaaccatctccaaagccaaagggcagccccgagaacc acaggtgtacaccctgcccccatcccgggaggagatgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa.

In another embodiment of the invention, polynucleotides of the invention comprise, or alternatively consist of, the following polynucleotide sequence encoding the light chain polypeptide sequence of SEQ ID NO: 821:

(SEQ ID NO: 831)
gccgccgtgctgacccagactccatctcccgtgtctgcagctgtgggag gcacagtcagcatcagttgccagtccagtaagagtgtttatagtaacta cttatcctggtttcagcagaaaccagggcagcctcccaagttcctgatc tacaaggcatccactctggcatctggggtcccatcgcggttcaaaggca gtggatctgggacacagttcactctcaccatcagcgacgtgcagtgtga cgatgctgccacttactactgtgcaggcggtgatactaatattagtgat aatgctttcggcggagggaccgaggtggtggtcaaacgtacggtagcgg ccccatctgtcttcatcttcccgccatctgatgagcagttgaaatctgg aactgcctctgttgtgtgcctgctgaataacttctatcccagagaggcc aaagtacagtggaaggtggataacgccctccaatcgggtaactcccagg agagtgtcacagagcaggacagcaaggacagcacctacagcctcagcag caccctgacgctgagcaaagcagactacgagaaacacaaagtctacgcc tgcgaagtcacccatcagggcctgagctcgcccgtcacaaagagcttca acaggggagagtgt.

In another embodiment of the invention, polynucleotides of the invention comprise, or alternatively consist of, the following polynucleotide sequence encoding the variable light chain polypeptide sequence of SEQ ID NO: 822:

(SEQ ID NO: 832)
gccgccgtgctgacccagactccatctcccgtgtctgcagctgtgggag gcacagtcagcatcagttgccagtccagtaagagtgtttatagtaacta cttatcctggtttcagcagaaaccagggcagcctcccaagttcctgatc tacaaggcatccactctggcatctggggtcccatcgcggttcaaaggca gtggatctgggacacagttcactctcaccatcagcgacgtgcagtgtga cgatgctgccacttactactgtgcaggcggtgatactaatattagtgat aatgctttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 830:

(SEQ ID NO: 840)
cgtacggtagcggccccatctgtcttcatcttcccgccatctgatgag cagttgaaatctggaactgcctctgttgtgtgcctgctgaataacttct atcccagagaggccaaagtacagtggaaggtggataacgccctccaatc gggtaactcccaggagagtgtcacagagcaggacagcaaggacagcacc tacagcctcagcagcaccctgacgctgagcaaagcagactacgagaaac -continued

```
acaaagtctacgcctgcgaagtcacccatcagggcctgagctcgcccgt cacaaagagcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 814; SEQ ID NO: 816; and SEQ ID NO: 818, which correspond to polynucleotides encoding the complementarity-determining regions (CDRs, or hypervariable regions) of the heavy chain sequence of SEQ ID NO: 801 or the variable heavy chain sequence of SEQ ID NO: 802, and/or one or more of the polynucleotide sequences of SEQ ID NO: 834; SEQ ID NO: 836; and SEQ ID NO: 838, which correspond to the complementarity-determining regions (CDRs, or hypervariable regions) of the light chain sequence of SEQ ID NO: 821 or the variable light chain sequence of SEQ ID NO: 822, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 813; SEQ ID NO: 815; SEQ ID NO: 817; and SEQ ID NO: 819, which correspond to polynucleotides encoding the framework regions (FRs or constant regions) of the heavy chain sequence of SEQ ID NO: 801 or the variable heavy chain sequence of SEQ ID NO: 802, and/or one or more of the polynucleotide sequences of SEQ ID NO: 833; SEQ ID NO: 835; SEQ ID NO: 837; and SEQ ID NO: 839, which correspond to the framework regions (FRs or constant regions) of the light chain sequence of SEQ ID NO: 821 or the variable light chain sequence of SEQ ID NO: 822, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 811 encoding the heavy chain sequence of SEQ ID NO: 801; the polynucleotide SEQ ID NO: 812 encoding the variable heavy chain sequence of SEQ ID NO: 802; the polynucleotide SEQ ID NO: 831 encoding the light chain sequence of SEQ ID NO: 821; the polynucleotide SEQ ID NO: 832 encoding the variable light chain sequence of SEQ ID NO: 822; polynucleotides encoding the complementarity-determining regions (SEQ ID NO: 814; SEQ ID NO: 816; and SEQ ID NO: 818) of the heavy chain sequence of SEQ ID NO: 801 or the variable heavy chain sequence of SEQ ID NO: 802; polynucleotides encoding the complementarity-determining regions (SEQ ID NO: 834; SEQ ID NO: 836; and SEQ ID NO: 838) of the light chain sequence of SEQ ID NO: 821 or the variable light chain sequence of SEQ ID NO: 822; polynucleotides encoding the framework regions (SEQ ID NO: 813; SEQ ID NO: 815; SEQ ID NO: 817; and SEQ ID NO: 819) of the heavy chain sequence of SEQ ID NO: 801 or the variable heavy chain sequence of SEQ ID NO: 802; and polynucleotides encoding the framework regions (SEQ ID NO: 833; SEQ ID NO: 835; SEQ ID NO: 837; and SEQ ID NO: 839) of the light chain sequence of SEQ ID NO: 821 or the variable light chain sequence of SEQ ID NO: 822.

In a preferred embodiment of the invention, polynucleotides of the invention comprise, or alternatively consist of, polynucleotides encoding Fab (fragment antigen binding) fragments having binding specificity for PCSK9. With respect to antibody Ab21, the polynucleotides encoding the full length Ab21 antibody comprise, or alternatively consist of, the polynucleotide SEQ ID NO: 811 encoding the heavy chain sequence of SEQ ID NO: 801 and the polynucleotide SEQ ID NO: 831 encoding the light chain sequence of SEQ ID NO: 821.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab21 following expression of the full-length polynucleotides in a suitable host. In another embodiment of the invention, anti-PCSK9 antibodies such as Ab21 or Fab fragments thereof may be produced via expression of Ab21 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab22

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 841:

```
                                         (SEQ ID NO: 851)
gaggtgcagctggtggagtctgggggaggcttggtccagcctgggggt ccctgagactctcctgtgcagcctctggattctccctcagtagttatgc aatgaattgggtccgccaggctccagggaaggggctggagtggatcggg gccattcgtagtagtggtgccacattcttcgcgagctccgtgaatggca gattcaccatctccagagacaattccaagaacacggtgtatcttcaaat gaacagcctgagagccgaggacacggctgtgtattactgtgcgagagat actaatgatggttggtatattaatcggttggatctctggggccaaggga ccctcgtcaccgtctcgagcgcctccaccaagggcccatcggtcttccc cctggcaccctcctccaagagcacctctgggggcacagcggccctgggc tgcctggtcaaggactacttcccgaaccggtgacggtgtcgtggaact caggcgccctgaccagcggcgtgcacaccttcccggctgtcctacagtc ctcaggactctactccctcagcagcgtggtgaccgtgccctccagcagc
```

-continued
ttgggcacccagacctacatctgcaacgtgaatcacaagcccagcaaca ccaaggtggacgcgagagttgagcccaaatcttgtgacaaaactcacac atgcccaccgtgcccagcacctgaactcctgggggggaccgtcagtcttc ctcttccccccaaaacccaaggacaccctcatgatctcccggacccctg aggtcacatgcgtggtggtggacgtgagccacgaagaccctgaggtcaa gttcaactggtacgtggacggcgtggaggtgcataatgccaagacaaag ccgcggggaggagcagtacgccagcacgtaccgtgtggtcagcgtcctca ccgtcctgcaccaggactggctgaatggcaaggagtacaagtgcaaggt ctccaacaaagccctcccagcccccatcgagaaaaccatctccaaagcc aaagggcagccccgagaaccacaggtgtacaccctgcccccatcccggg aggagatgaccaagaaccaggtcagcctgacctgcctggtcaaaggctt ctatcccagcgacatcgccgtggagtgggagagcaatgggcagccggag aacaactacaagaccacgcctcccgtgctggactccgacggctccttct tcctctacagcaagctcaccgtggacaagagcaggtggcagcaggggaa cgtcttctcatgctccgtgatgcatgaggctctgcacaaccactacacg cagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 842:

(SEQ ID NO: 852)
gaggtgcagctggtggagtctgggggaggcttggtccagcctggggggt ccctgagactctcctgtgcagcctctggattctccctcagtagttatgc aatgaattgggtccgccaggctccagggaaggggctggagtggatcggg gccattcgtagtagtggtgccacattcttcgcgagctccgtgaatggca gattcaccatctccagagacaattccaagaacacggtgtatcttcaaat gaacagcctgagagccgaggacacggctgtgtattactgtgcgagagat actaatgatggttggtatattaatcggttggatctctggggccaaggga ccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 850:

(SEQ ID NO: 860)
gcctccaccaagggcccatcggtcttccccctggcaccctcctccaaga gcacctctggggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacgcgagagtt gagcccaaatcttgtgacaaaactcacacatgcccaccgtgcccagca cctgaactcctgggggggaccgtcagtcttcctcttccccccaaaaccca aggacaccctcatgatctcccggacccctgaggtcacatgcgtggtggt ggacgtgagccacgaagaccctgaggtcaagttcaactggtacgtggac ggcgtggaggtgcataatgccaagacaaagccgcgggaggagcagtacg ccagcacgtaccgtgtggtcagcgtcctcaccgtcctgcaccaggactg gctgaatggcaaggagtacaagtgcaaggtctccaacaaagcccctccca gcccccatcgagaaaccatctccaaagccaaagggcagccccgagaac cacaggtgtacaccctgcccccatcccgggaggagatgaccaagaacca ggtcagcctgacctgcctggtcaaaggcttctatcccagcgacatcgcc gtggagtgggagagcaatgggcagccggagaacaactacaagaccacgc ctcccgtgctggactccgacggctccttcttcctctacagcaagctcac cgtggacaagagcaggtggcagcaggggaacgtcttctcatgctccgtg atgcatgaggctctgcacaaccactacacgcagaagagcctctccctgt ctccgggtaaa.

In another embodiment of the invention, polynucleotides of the invention comprise, or alternatively consist of, the following polynucleotide sequence encoding the light chain polypeptide sequence of SEQ ID NO: 861:

(SEQ ID NO: 871)
gccgtgctgacccagtctccttccaccctgtctgcatctgtaggagaca gagtcaccatcacttgccagtccagtaagagtgtttatagtaactactt atcctggtttcagcagaaaccagggaaagcccctaagttcctgatctat aaggcatccactctggcatctggggtcccatcaaggttcagcggcagtg gatctgggacagaattcactctcaccatcagcagcctgcagcctgatga ttttgcaacttattactgcgcaggcggtgatactaatattgctgataat gctttcggcggagggaaccaaggtggaaatcaaacgtacggtagcggccc catctgtcttcatcttcccgccatctgatgagcagttgaaatctggaac tgcctctgttgtgtgcctgctgaataacttctatcccagagaggccaaa gtacagtggaaggtggataacgccctccaatcgggtaactcccaggaga gtgtcacagagcaggacagcaaggacagcacctacagcctcagcagcac cctgacgctgagcaaagcagactacgagaaacacaaagtctacgcctg cgaagtcacccatcagggcctgagctcgcccgtcacaaagagcttcaa caggggagagtgt.

In another embodiment of the invention, polynucleotides of the invention comprise, or alternatively consist of, the following polynucleotide sequence encoding the variable light chain polypeptide sequence of SEQ ID NO: 862:

(SEQ ID NO: 872)
gccgtgctgacccagtctccttccaccctgtctgcatctgtaggagacag agtcaccatcacttgccagtccagtaagagtgtttatagtaactacttat cctggtttcagcagaaaccagggaaagcccctaagttcctgatctataag gcatccactctggcatctggggtcccatcaaggttcagcggcagtggatc tgggacagaattcactctcaccatcagcagcctgcagcctgatgattttg -continued
caacttattactgcgcaggcggtgatactaatattgctgataatgctttc ggcggaggaaccaaggtggaaatcaaa.

In another embodiment of the invention, polynucleotides of the invention comprise, or alternatively consist of, the following polynucleotide sequence encoding the constant light chain polypeptide sequence of SEQ ID NO: 870:

(SEQ ID NO: 880)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 854; SEQ ID NO: 856; and SEQ ID NO: 858, which correspond to polynucleotides encoding the complementarity-determining regions (CDRs, or hypervariable regions) of the heavy chain sequence of SEQ ID NO: 841 or the variable heavy chain sequence of SEQ ID NO: 842, and/or one or more of the polynucleotide sequences of SEQ ID NO: 874; SEQ ID NO: 876; and SEQ ID NO: 878, which correspond to the complementarity-determining regions (CDRs, or hypervariable regions) of the light chain sequence of SEQ ID NO: 861 or the variable light chain sequence of SEQ ID NO: 862, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 853; SEQ ID NO: 855; SEQ ID NO: 857; and SEQ ID NO: 859, which correspond to polynucleotides encoding the framework regions (FRs or constant regions) of the heavy chain sequence of SEQ ID NO: 841 or the variable heavy chain sequence of SEQ ID NO: 842, and/or one or more of the polynucleotide sequences of SEQ ID NO: 873; SEQ ID NO: 875; SEQ ID NO: 877; and SEQ ID NO: 879, which correspond to the framework regions (FRs or constant regions) of the light chain sequence of SEQ ID NO: 861 or the variable light chain sequence of SEQ ID NO: 862, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 851 encoding the heavy chain sequence of SEQ ID NO: 841; the polynucleotide SEQ ID NO: 852 encoding the variable heavy chain sequence of SEQ ID NO: 842; the polynucleotide SEQ ID NO: 871 encoding the light chain sequence of SEQ ID NO: 861; the polynucleotide SEQ ID NO: 872 encoding the variable light chain sequence of SEQ ID NO: 862; polynucleotides encoding the complementarity-determining regions (SEQ ID NO: 854; SEQ ID NO: 856; and SEQ ID NO: 858) of the heavy chain sequence of SEQ ID NO: 841 or the variable heavy chain sequence of SEQ ID NO: 842; polynucleotides encoding the complementarity-determining regions (SEQ ID NO: 874; SEQ ID NO: 876; and SEQ ID NO: 878) of the light chain sequence of SEQ ID NO: 861 or the variable light chain sequence of SEQ ID NO: 862; polynucleotides encoding the framework regions (SEQ ID NO: 853; SEQ ID NO: 855; SEQ ID NO: 857; and SEQ ID NO: 859) of the heavy chain sequence of SEQ ID NO: 841 or the variable heavy chain sequence of SEQ ID NO: 842; and polynucleotides encoding the framework regions (SEQ ID NO: 873; SEQ ID NO: 875; SEQ ID NO: 877; and SEQ ID NO: 879) of the light chain sequence of SEQ ID NO: 861 or the variable light chain sequence of SEQ ID NO: 862.

In a preferred embodiment of the invention, polynucleotides of the invention comprise, or alternatively consist of, polynucleotides encoding Fab (fragment antigen binding) fragments having binding specificity for PCSK9. With respect to antibody Ab22, the polynucleotides encoding the full length Ab22 antibody comprise, or alternatively consist of, the polynucleotide SEQ ID NO: 851 encoding the heavy chain sequence of SEQ ID NO: 841 and the polynucleotide SEQ ID NO: 871 encoding the light chain sequence of SEQ ID NO: 861.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab22 following expression of the full-length polynucleotides in a suitable host. In another embodiment of the invention, anti-PCSK9 antibodies such as Ab22 or Fab fragments thereof may be produced via expression of Ab22 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab23

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 881:

(SEQ ID NO: 891)
cagtcgttggaggagtccgggggagacctggtcaagcctggggcatccct gacactcacctgcaaagcctctggattctccttcagtagcggctactaca tgtgctgggtccgccaggctccagggaagggctggagtggatcgcatgc atttatgctggtagtggtggtagcactttcttcgcgaactgggcgaaagg -continued
```
ccgattcaccatctccaaaacctcgtcgaccacggtgactctgcaaatga ccagtctgacagccgcggacacggccacctatttctgtgcgagagatggt ggttatgctggctatggttatgctttctttaacttgtggggcccggggac cctcgtcaccgtctcgagcgcctccaccaagggcccatcggtcttccccc tggcaccctcctccaagagcacctctgggggcacagcggccctgggctgc ctggtcaaggactacttccccgaaccggtgacggtgtcgtggaactcagg cgccctgaccagcggcgtgcacaccttcccggctgtcctacagtcctcag gactctactccctcagcagcgtggtgaccgtgcctccagcagcttgggc acccagacctacatctgcaacgtgaatcacaagcccagcaacaccaaggt ggacaagagagttgagcccaaatcttgtgacaaaactcacacatgcccac cgtgcccagcacctgaactcctgggggaccgtcagtcttcctcttcccc ccaaaacccaaggacaccctcatgatctcccggacccctgaggtcacatg cgtggtggtggacgtgagccacgaagaccctgaggtcaagttcaactggt acgtggacggcgtggaggtgcataatgccaagacaaagccgcgggaggag cagtacgccagcacgtaccgtgtggtcagcgtcctcaccgtcctgcacca ggactggctgaatggcaaggagtacaagtgcaaggtctccaacaaagccc tcccagcccccatcgagaaaaccatctccaaagccaaagggcagcccga gaaccacaggtgtacaccctgcccccatcccgggaggagatgaccaagaa ccaggtcagcctgacctgcctggtcaaaggcttctatcccagcgacatcg ccgtggagtgggagagcaatgggcagccggagaacaactacaagaccacg cctcccgtgctggactccgacggctccttcttcctctacagcaagctcac cgtggacaagagcaggtggcagcaggggaacgtcttctcatgctccgtga tgcatgaggctctgcacaaccactacacgcagaagagcctctccctgtct ccgggtaaa.
```

In another embodiment of the invention, the polynucleotides of the invention comprise, or alternatively consist of, the following polynucleotide sequence encoding the variable heavy chain polypeptide sequence of SEQ ID NO: 882:

```
                                    (SEQ ID NO: 892)
cagtcgttggaggagtccggggggagacctggtcaagcctggggcatccct gacactcacctgcaaagcctctggattctccttcagtagcggctactaca tgtgctgggtccgccaggctccagggaaggggctggagtggatcgcatgc atttatgctggtagtggtggtagcacttttcttcgcgaactgggcgaaagg ccgattcaccatctccaaaacctcgtcgaccacggtgactctgcaaatga ccagtctgacagccgcggacacggccacctatttctgtgcgagagatggt ggttatgctggctatggttatgctttctttaacttgtggggcccggggac cctcgtcaccgtctcgagc.
```

In another embodiment of the invention, polynucleotides of the invention comprise, or alternatively consist of, the following polynucleotide sequence encoding the constant heavy chain polypeptide sequence of SEQ ID NO: 890:

```
                                    (SEQ ID NO: 900)
gcctccaccaagggcccatcggtcttccccctggcacctcctccaagag cacctctgggggcacagcggccctgggctgcctggtcaaggactacttcc
```

```
ccgaaccggtgacggtgtcgtggaactcaggcgccctgaccagcggcgtg cacaccttcccggctgtcctacagtcctcaggactctactccctcagcag cgtggtgaccgtgcctccagcagcttgggcacccagacctacatctgca acgtgaatcacaagcccagcaacaccaaggtggacaagagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.
```

In another embodiment of the invention, polynucleotides of the invention comprise, or alternatively consist of, the following polynucleotide sequence encoding the light chain polypeptide sequence of SEQ ID NO: 901:

```
                                    (SEQ ID NO: 911)
gatgttgtgatgacccagactccagcctccgtgtctgaacctgtgggagg cacagtcaccatcaagtgccaggccagtgagaggatttatagtggtttgg cctggtatcagcagaaaccagggcagcctcccaagctcctgatctatggt gcatccactctggcatctggggtcccatcgcggttcaaaggcagtggatc tgggacagatttcactctcaccatcagcgacctggagtgtgacgatgctg ccatttactactgtcaatgtacttattatggttctagttatcctaatgtt ttcggcggagggaccgaggtggtggtcaaacgtacggtagcggccccatc tgtcttcatcttcccgccatctgatgagcagttgaaatctggaactgcct ctgttgtgtgcctgctgaataacttctatcccagagaggccaaagtacag tggaaggtggataacgcctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagag tgt.
```

In another embodiment of the invention, polynucleotides of the invention comprise, or alternatively consist of, the following polynucleotide sequence encoding the variable light chain polypeptide sequence of SEQ ID NO: 902:

```
                                    (SEQ ID NO: 912)
gatgttgtgatgacccagactccagcctccgtgtctgaacctgtgggagg cacagtcaccatcaagtgccaggccagtgagaggatttatagtggtttgg
```

-continued
cctggtatcagcagaaaccagggcagcctcccaagctcctgatctatggt gcatccactctggcatctggggtcccatcgcggttcaaaggcagtggatc tgggacagatttcactctcaccatcagcgacctggagtgtgacgatgctg ccatttactactgtcaatgtacttattatggttctagttatcctaatgtt ttcggcggagggaccgaggtggtggtcaaa.

In another embodiment of the invention, polynucleotides of the invention comprise, or alternatively consist of, the following polynucleotide sequence encoding the constant light chain polypeptide sequence of SEQ ID NO: 910:

(SEQ ID NO: 920)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcacccctgacgctgagcaaagcagactacgagaaacacaaag tctacgcctgcgaagtcacccatcagggcctgagctcgcccgtcacaaag agcttcaacaggggagagtgt.

In a further embodiment of the invention, polynucleotides encoding antibody fragments having binding specificity to PCSK9 comprise, or alternatively consist of, one or more of the polynucleotide sequences of SEQ ID NO: 894; SEQ ID NO: 896; and SEQ ID NO: 898, which correspond to polynucleotides encoding the complementarity-determining regions (CDRs, or hypervariable regions) of the heavy chain sequence of SEQ ID NO: 881 or the variable heavy chain sequence of SEQ ID NO: 882, and/or one or more of the polynucleotide sequences of SEQ ID NO: 914; SEQ ID NO: 916; and SEQ ID NO: 918, which correspond to the complementarity-determining regions (CDRs, or hypervariable regions) of the light chain sequence of SEQ ID NO: 901 or the variable light chain sequence of SEQ ID NO: 902, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 893; SEQ ID NO: 895; SEQ ID NO: 897; and SEQ ID NO: 899, which correspond to polynucleotides encoding the framework regions (FRs or constant regions) of the heavy chain sequence of SEQ ID NO: 881 or the variable heavy chain sequence of SEQ ID NO: 882, and/or one or more of the polynucleotide sequences of SEQ ID NO: 913; SEQ ID NO: 915; SEQ ID NO: 917; and SEQ ID NO: 919, which correspond to the framework regions (FRs or constant regions) of the light chain sequence of SEQ ID NO: 901 or the variable light chain sequence of SEQ ID NO: 902, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 891 encoding the heavy chain sequence of SEQ ID NO: 881; the polynucleotide SEQ ID NO: 892 encoding the variable heavy chain sequence of SEQ ID NO: 882; the polynucleotide SEQ ID NO: 911 encoding the light chain sequence of SEQ ID NO: 901; the polynucleotide SEQ ID NO: 912 encoding the variable light chain sequence of SEQ ID NO: 902; polynucleotides encoding the complementarity-determining regions (SEQ ID NO: 894; SEQ ID NO: 896; and SEQ ID NO: 898) of the heavy chain sequence of SEQ ID NO: 881 or the variable heavy chain sequence of SEQ ID NO: 882; polynucleotides encoding the complementarity-determining regions (SEQ ID NO: 914; SEQ ID NO: 916; and SEQ ID NO: 918) of the light chain sequence of SEQ ID NO: 901 or the variable light chain sequence of SEQ ID NO: 902; polynucleotides encoding the framework regions (SEQ ID NO: 893; SEQ ID NO: 895; SEQ ID NO: 897; and SEQ ID NO: 899) of the heavy chain sequence of SEQ ID NO: 881 or the variable heavy chain sequence of SEQ ID NO: 882; and polynucleotides encoding the framework regions (SEQ ID NO: 913; SEQ ID NO: 915; SEQ ID NO: 917; and SEQ ID NO: 919) of the light chain sequence of SEQ ID NO: 901 or the variable light chain sequence of SEQ ID NO: 902.

In a preferred embodiment of the invention, polynucleotides of the invention comprise, or alternatively consist of, polynucleotides encoding Fab (fragment antigen binding) fragments having binding specificity for PCSK9. With respect to antibody Ab23, the polynucleotides encoding the full length Ab23 antibody comprise, or alternatively consist of, the polynucleotide SEQ ID NO: 891 encoding the heavy chain sequence of SEQ ID NO: 881 and the polynucleotide SEQ ID NO: 911 encoding the light chain sequence of SEQ ID NO: 901.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab23 following expression of the full-length polynucleotides in a suitable host. In another embodiment of the invention, anti-PCSK9 antibodies such as Ab23 or Fab fragments thereof may be produced via expression of Ab23 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab24

In one embodiment, the invention is further directed to polynucleotides encoding antibody polypeptides having binding specificity to PCSK9. In one embodiment of the invention, polynucleotides of the invention comprise, or alternatively consist of, the following polynucleotide sequence encoding the heavy chain sequence of SEQ ID NO: 921:

(SEQ ID NO: 931)
cagtcgttggaggagtccggggagacctggtcaagcctggggcatccct gacactcacctgcaaagcctctggattctccttcagtagcggctactaca tgtgctgggtccgccaggctccagggaaggggctggagtggatcgcatgc atttatgctggtagtggtggtagcactttcttcgcgaactgggcgaaagg ccgattcaccatctccaaacctcgtcgaccacggtgactctgcaaatga ccagtctgacagccgcggacacggccacctatttctgtgcgagagatggt ggttatgctggctatggttatgctttctttaacttgtggggcccggggac cctcgtcaccgtctcgagcgcctccaccaagggcccatcggtcttccccc tggcaccctcctccaagagcacctctgggggcacagcggccctgggctgc ctggtcaaggactacttccccgaaccggtgacggtgtcgtggaactcagg cgccctgaccagcggcgtgcacaccttcccggctgtcctacagtcctcag gactctactccctcagcagcgtggtgaccgtgccctccagcagcttgggc acccagacctacatctgcaacgtgaatcacaagcccagcaacaccaaggt ggacaagagagttgagcccaaatcttgtgacaaaactcacacatgcccac cgtgcccagcacctgaactcctggggggaccgtcagtcttcctcttcccc ccaaaacccaaggacaccctcatgatctcccggacccctgaggtcacatg cgtggtggtggacgtgagccacgaagaccctgaggtcaagttcaactggt acgtggacggcgtggaggtgcataatgccaagacaaagccgcgggaggag cagtacgccagcacgtaccgtgtggtcagcgtcctcaccgtcctgcacca ggactggctgaatggcaaggagtacaagtgcaaggtctccaacaaagccc tcccagcccccatcgagaaaaccatctccaaagccaaagggcagccccga gaaccacaggtgtacaccctgcccccatcccgggaggagatgaccaagaa ccaggtcagcctgacctgcctggtcaaaggcttctatcccagcgacatcg ccgtggagtgggagagcaatgggcagccggagaacaactacaagaccacg cctcccgtgctggactccgacggctccttcttcctctacagcaagctcac cgtggacaagagcaggtggcagcaggggaacgtcttctcatgctccgtga tgcatgaggctctgcacaaccactacacgcagaagagcctctccctgtct ccgggtaaa.

In another embodiment of the invention, the polynucleotides of the invention comprise, or alternatively consist of, the following polynucleotide sequence encoding the variable heavy chain polypeptide sequence of SEQ ID NO: 922:

(SEQ ID NO: 932)
cagtcgttggaggagtccggggagacctggtcaagcctggggcatccct gacactcacctgcaaagcctctggattctccttcagtagcggctactaca tgtgctgggtccgccaggctccagggaaggggctggagtggatcgcatgc atttatgctggtagtggtggtagcactttcttcgcgaactgggcgaaagg ccgattcaccatctccaaacctcgtcgaccacggtgactctgcaaatga ccagtctgacagccgcggacacggccacctatttctgtgcgagagatggt ggttatgctggctatggttatgctttctttaacttgtggggcccggggac cctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 930:

(SEQ ID NO: 940)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 941:

(SEQ ID NO: 951)
gatgttgtgatgacccagactccagcctccgtgtctgaacctgtgggagg cacagtcaccatcaagtgccaggccagtgagaggatttatagtggtttgg cctggtatcagcagaaaccagggcagcctcccaagctcctgatctatggt gcatccactctggcatctggggtcccatcgcggttcaaaggcagtggatc tgggacagatttcactctcaccatcagcgacctggagtgtgacgatgctg ccatttactactgtcaagctacttattatggttctagttatcctaatgtt ttcggcggagggaccgaggtggtggtcaaacgtacggtagcggccccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagag tgt.

In another embodiment of the invention, polynucleotides of the invention comprise, or alternatively consist of, the following polynucleotide sequence encoding the variable light chain polypeptide sequence of SEQ ID NO: 942:

```
                                            (SEQ ID NO: 952)
gatgttgtgatgacccagactccagcctccgtgtctgaacctgtgggagg cacagtcaccatcaagtgccaggccagtgagaggatttatagtggtttgg cctggtatcagcagaaaccagggcagcctcccaagctcctgatctatggt gcatccactctggcatctgggtcccatcgcggttcaaaggcagtggatc tgggacagatttcactctcaccatcagcgacctggagtgtgacgatgctg ccatttactactgtcaagctacttattatggttctagttatcctaatgtt ttcggcggagggaccgaggtggtggtcaaa.
```

In another embodiment of the invention, polynucleotides of the invention comprise, or alternatively consist of, the following polynucleotide sequence encoding the constant light chain polypeptide sequence of SEQ ID NO: 950:

```
                                            (SEQ ID NO: 960)
cgtacggtagcggccccatctgtcttcatcttcccgccatctgatgagca gttgaaatctggaactgcctctgttgtgtgcctgctgaataacttctatc ccagagaggccaaagtacagtggaaggtggataacgccctccaatcgggt aactcccaggagagtgtcacagagcaggacagcaaggacagcacctacag cctcagcagcaccctgacgctgagcaaagcagactacgagaaacacaaag tctacgcctgcgaagtcacccatcagggcctgagctcgcccgtcacaaag agcttcaacaggggagagtgt.
```

In a further embodiment of the invention, polynucleotides encoding antibody fragments having binding specificity to PCSK9 comprise, or alternatively consist of, one or more of the polynucleotide sequences of SEQ ID NO: 934; SEQ ID NO: 936; and SEQ ID NO: 938, which correspond to polynucleotides encoding the complementarity-determining regions (CDRs, or hypervariable regions) of the heavy chain sequence of SEQ ID NO: 921 or the variable heavy chain sequence of SEQ ID NO: 922, and/or one or more of the polynucleotide sequences of SEQ ID NO: 954; SEQ ID NO: 956; and SEQ ID NO: 958, which correspond to the complementarity-determining regions (CDRs, or hypervariable regions) of the light chain sequence of SEQ ID NO: 941 or the variable light chain sequence of SEQ ID NO: 942, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to PCSK9 comprise, or alternatively consist of, one or more of the polynucleotide sequences of SEQ ID NO: 933; SEQ ID NO: 935; SEQ ID NO: 937; and SEQ ID NO: 939, which correspond to polynucleotides encoding the framework regions (FRs or constant regions) of the heavy chain sequence of SEQ ID NO: 921 or the variable heavy chain sequence of SEQ ID NO: 922, and/or one or more of the polynucleotide sequences of SEQ ID NO: 953; SEQ ID NO: 955; SEQ ID NO: 957; and SEQ ID NO: 959, which correspond to the framework regions (FRs or constant regions) of the light chain sequence of SEQ ID NO: 941 or the variable light chain sequence of SEQ ID NO: 942, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to PCSK9 comprise, or alternatively consist of, one, two, three or more, including all of the following polynucleotides encoding antibody fragments: the polynucleotide SEQ ID NO: 931 encoding the heavy chain sequence of SEQ ID NO: 921; the polynucleotide SEQ ID NO: 932 encoding the variable heavy chain sequence of SEQ ID NO: 922; the polynucleotide SEQ ID NO: 951 encoding the light chain sequence of SEQ ID NO: 941; the polynucleotide SEQ ID NO: 952 encoding the variable light chain sequence of SEQ ID NO: 942; polynucleotides encoding the complementarity-determining regions (SEQ ID NO: 934; SEQ ID NO: 936; and SEQ ID NO: 938) of the heavy chain sequence of SEQ ID NO: 921 or the variable heavy chain sequence of SEQ ID NO: 922; polynucleotides encoding the complementarity-determining regions (SEQ ID NO: 954; SEQ ID NO: 956; and SEQ ID NO: 958) of the light chain sequence of SEQ ID NO: 941 or the variable light chain sequence of SEQ ID NO: 942; polynucleotides encoding the framework regions (SEQ ID NO: 933; SEQ ID NO: 935; SEQ ID NO: 937; and SEQ ID NO: 939) of the heavy chain sequence of SEQ ID NO: 921 or the variable heavy chain sequence of SEQ ID NO: 922; and polynucleotides encoding the framework regions (SEQ ID NO: 953; SEQ ID NO: 955; SEQ ID NO: 957; and SEQ ID NO: 959) of the light chain sequence of SEQ ID NO: 941 or the variable light chain sequence of SEQ ID NO: 942.

In a preferred embodiment of the invention, polynucleotides of the invention comprise, or alternatively consist of, polynucleotides encoding Fab (fragment antigen binding) fragments having binding specificity for PCSK9. With respect to antibody Ab24, the polynucleotides encoding the full length Ab24 antibody comprise, or alternatively consist of, the polynucleotide SEQ ID NO: 931 encoding the heavy chain sequence of SEQ ID NO: 921 and the polynucleotide SEQ ID NO: 951 encoding the light chain sequence of SEQ ID NO: 941.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab24 following expression of the full-length polynucleotides in a suitable host. In another embodiment of the invention, anti-PCSK9 antibodies such as Ab24 or Fab fragments thereof may be produced via expression of Ab24 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

In one embodiment, the invention is directed to an isolated polynucleotide comprising a polynucleotide encoding an anti-PCSK9 V$_H$ antibody amino acid sequence selected from SEQ ID NO: 12, SEQ ID NO: 52, SEQ ID NO: 92, SEQ ID NO: 132, SEQ ID NO: 172, SEQ ID NO: 212, SEQ ID NO: 252, SEQ ID NO: 292, SEQ ID NO: 332, SEQ ID NO: 372, SEQ ID NO: 412, SEQ ID NO: 452, SEQ ID NO: 492, SEQ ID NO: 532, SEQ ID NO: 572, SEQ ID NO: 612, SEQ ID NO: 652, SEQ ID NO: 692, SEQ ID NO: 732, SEQ ID NO: 772, SEQ ID NO: 812, SEQ ID NO: 852, SEQ ID NO: 892, SEQ ID NO: 932, or encoding a variant thereof wherein at least one framework residue (FR residue) has been substituted with an amino acid present at the corresponding position in a rabbit anti-PCSK9 antibody V$_H$ polypeptide or a conservative amino acid substitution.

In another embodiment, the invention is directed to an isolated polynucleotide comprising the polynucleotide sequence encoding an anti-PCSK9 V$_L$ antibody amino acid selected from SEQ ID NO: 32, SEQ ID NO: 72, SEQ ID NO: 112, SEQ ID NO: 152, SEQ ID NO: 192, SEQ ID NO: 232, SEQ ID NO: 272, SEQ ID NO: 312, SEQ ID NO: 352, SEQ ID NO: 392, SEQ ID NO: 432, SEQ ID NO: 472, SEQ ID NO: 512, SEQ ID NO: 552, SEQ ID NO: 592, SEQ ID NO: 632, SEQ ID NO: 672, SEQ ID NO: 712, SEQ ID NO: 752, SEQ ID NO: 792, SEQ ID NO: 832, SEQ ID NO: 872, SEQ ID NO: 912, SEQ ID NO: 952, or encoding a variant thereof wherein at least one framework residue (FR residue) has been substituted with an amino acid present at the corresponding position in a rabbit anti-PCSK9 antibody V$_L$ polypeptide or a conservative amino acid substitution.

In yet another embodiment, the invention is directed to one or more heterologous polynucleotides comprising a sequence encoding the polypeptides contained in SEQ ID NO: 2 and SEQ ID NO: 22; SEQ ID NO: 42 and SEQ ID NO: 62; SEQ ID NO: 82 and SEQ ID NO: 102; SEQ ID NO: 122 and SEQ ID NO: 142; SEQ ID NO: 162 and SEQ ID NO: 182; SEQ ID NO: 202 and SEQ ID NO: 222, SEQ ID NO: 242 and SEQ ID NO: 262; SEQ ID NO: 282 and SEQ ID NO: 302; SEQ ID NO: 322 and SEQ ID NO: 342; SEQ ID NO: 362 and SEQ ID NO: 382; SEQ ID NO: 402 and SEQ ID NO: 422; SEQ ID NO: 442 and SEQ ID NO: 462; SEQ ID NO: 482 and SEQ ID NO: 502; SEQ ID NO: 522 and SEQ ID NO: 542; SEQ ID NO: 562 and SEQ ID NO: 582; SEQ ID NO: 602 and SEQ ID NO: 622; SEQ ID NO: 642 and SEQ ID NO: 662; SEQ ID NO: 682 and SEQ ID NO: 702; SEQ ID NO: 722 and SEQ ID NO: 742; SEQ ID NO: 762 and SEQ ID NO: 782; SEQ ID NO: 802 and SEQ ID NO: 822; SEQ ID NO: 842 and SEQ ID NO: 862; SEQ ID NO: 882 and SEQ ID NO: 902; or SEQ ID NO: 922 and SEQ ID NO: 942.

In another embodiment, the invention is directed to an isolated polynucleotide that expresses a polypeptide containing at least one CDR polypeptide derived from an anti-PCSK9 antibody wherein said expressed polypeptide alone specifically binds PCSK9 or specifically binds PCSK9 when expressed in association with another polynucleotide sequence that expresses a polypeptide containing at least one CDR polypeptide derived from an anti-PCSK9 antibody wherein said at least one CDR is selected from those contained in the V$_L$ or V$_H$ polypeptides of SEQ ID NOS: 2, 22, 42, 62, 82, 102, 122, 142, 162, 182, 202, 222, 242, 262, 282, 302, 322, 342, 362, 382, 402, 422, 442, 462, 482, 502, 522, 542, 562, 582, 602, 622, 642, 662, 682, 702, 722, 742, 762, 782, 802, 822, 842, 862, 882, 902, 922, or 942. More specifically, the at least one CDR comprises SEQ ID NOS: 4, 6, 8, 24, 26, 28, 44, 46, 48, 64, 66, 68, 84, 86, 88, 104, 106, 108, 124, 126, 128, 144, 146, 148, 164, 166, 168, 184, 186, 188, 204, 206, 208, 224, 226, 228, 244, 246, 248, 264, 266, 268, 284, 286, 288, 304, 306, 308, 324, 326, 328, 344, 346, 348, 364, 366, 368, 384, 386, 388, 404, 406, 408, 424, 426, 428, 444, 446, 448, 464, 466, 468, 484, 486, 488, 504, 506, 508, 524, 526, 528, 544, 546, 548, 564, 566, 568, 584, 586, 588, 604, 606, 608, 624, 626, 628, 644, 646, 648, 664, 666, 668, 684, 686, 688, 704, 706, 708, 724, 726, 728, 744, 746, 748, 764, 766, 768, 784, 786, 788, 804, 806, 808, 824, 826, 828, 844, 846, 848, 864, 866, 884, 886, 888, 904, 906, 908, 924, 926, 928, 944, 946, or 948.

Host cells and vectors comprising said polynucleotides are also contemplated.

The invention further contemplates vectors comprising the polynucleotide sequences encoding the variable heavy and light chain polypeptide sequences, as well as the individual complementarity-determining regions (CDRs, or hypervariable regions), as set forth herein, as well as host cells comprising said vector sequences. In one embodiment of the invention, the host cell is a yeast cell. In another embodiment of the invention, the yeast host cell belongs to the genus *Pichia*.

B-Cell Screening and Isolation

In one embodiment, the present invention contemplates the preparation and isolation of a clonal population of antigen-specific B cells that may be used for isolating at least one PCSK9 antigen-specific cell, which can be used to produce a monoclonal antibody against PCSK9, which is specific to a desired PCSK9 antigen, or a nucleic acid sequence corresponding to such an antibody. Methods of preparing and isolating said clonal population of antigen-specific B cells are taught, for example, in U.S. patent publication no. US 2007/0269868 to Carvalho-Jensen et al., the disclosure of which is herein incorporated by reference in its entirety. Methods of preparing and isolating said clonal population of antigen-specific B cells are also taught herein in the examples. Methods of "enriching" a cell population by size or density are known in the art. See, e.g., U.S. Pat. No. 5,627,052. These steps can be used in addition to enriching the cell population by antigen-specificity.

Methods of Humanizing Antibodies

In another embodiment, the present invention contemplates methods for humanizing antibody heavy and light chains. Methods for humanizing antibody heavy and light chains which may be applied to anti-PCSK9 antibodies are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties.

Methods of Producing Antibodies and Fragments Thereof

In another embodiment, the present invention contemplates methods for producing anti-PCSK9 antibodies and fragments thereof. Methods for producing anti-PCSK9 antibodies and fragments thereof secreted from polyploidal, preferably diploid or tetraploid strains of mating competent yeast are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties. A preferred yeast for manufacture of antibodies is *Pichia*, and more preferably *Pichia pastoris*. However, antibodies according to the invention potentially may be made in other yeast such as other mating competent yeast of the Saccharomycetaceae family, which includes the genera *Arxiozyma; Ascobotryozyma; Citeromyces; Debaryomyces; Dekkera; Eremothecium; Issatchenkia; Kazachstania; Kluyveromy-*

*ces; Kodamaea; Lodderomyces; Pachysolen; Pichia; Saccharomyces; Saturnispora; Tetrapisispora; Torulaspora; Williopsis*; and *Zygosaccharomyces*. Other types of yeast potentially useful for making antibody proteins according to the invention include *Yarrowia; Rhodosporidium; Candida; Hansenula; Filobasium; Sporidiobolus; Bullera; Leucosporidium* and *Filobasidella*.

Other methods of producing antibodies are well known to those of ordinary skill in the art. For example, methods of producing chimeric antibodies are now well known in the art (See, for example, U.S. Pat. No. 4,816,567 to Cabilly et al.; Morrison et al., P.N.A.S. USA, 81:8651-55 (1984); Neuberger, M. S. et al., Nature, 314:268-270 (1985); Boulianne, G. L. et al., Nature, 312:643-46 (1984), the disclosures of each of which are herein incorporated by reference in their entireties).

Likewise, other methods of producing humanized antibodies are now well known in the art (See, for example, U.S. Pat. Nos. 5,530,101, 5,585,089, 5,693,762, and 6,180,370 to Queen et al; U.S. Pat. Nos. 5,225,539 and 6,548,640 to Winter; U.S. Pat. Nos. 6,054,297, 6,407,213 and 6,639,055 to Carter et al; U.S. Pat. No. 6,632,927 to Adair; Jones, P. T. et al, Nature, 321:522-525 (1986); Reichmann, L., et al, Nature, 332:323-327 (1988); Verhoeyen, M, et al, Science, 239:1534-36 (1988), the disclosures of each of which are herein incorporated by reference in their entireties).

Antibody polypeptides of the invention having PCSK9 binding specificity may also be produced by constructing, using conventional techniques well known to those of ordinary skill in the art, an expression vector containing an operon and a DNA sequence encoding an antibody heavy chain in which the DNA sequence encoding the CDRs required for antibody specificity is derived from a non-human cell source, preferably a rabbit B-cell source, while the DNA sequence encoding the remaining parts of the antibody chain is derived from a human cell source.

A second expression vector is produced using the same conventional means well known to those of ordinary skill in the art, said expression vector containing an operon and a DNA sequence encoding an antibody light chain in which the DNA sequence encoding the CDRs required for antibody specificity is derived from a non-human cell source, preferably a rabbit B-cell source, while the DNA sequence encoding the remaining parts of the antibody chain is derived from a human cell source.

The expression vectors are transfected into a host cell by convention techniques well known to those of ordinary skill in the art to produce a transfected host cell, said transfected host cell cultured by conventional techniques well known to those of ordinary skill in the art to produce said antibody polypeptides.

The host cell may be co-transfected with the two expression vectors described above, the first expression vector containing DNA encoding an operon and a light chain-derived polypeptide and the second vector containing DNA encoding an operon and a heavy chain-derived polypeptide. The two vectors contain different selectable markers, but preferably achieve substantially equal expression of the heavy and light chain polypeptides. Alternatively, a single vector may be used, the vector including DNA encoding both the heavy and light chain polypeptides. The coding sequences for the heavy and light chains may comprise cDNA, genomic DNA, or both.

Host cells which potentially may be used to express the subject antibody polypeptides may include bacterial cells such as *E. coli*, or eukaryotic cells such as *P. pastoris*, other yeast cells, fungi, insect cells, mammalian cells, and plant cells. In one embodiment of the invention, a mammalian cell of a well-defined type may be for this purpose, such as a myeloma cell, a Chinese hamster ovary (CHO) cell line, a NSO cell line, or a HEK293 cell line.

The general methods by which the vectors may be constructed, transfection methods required to produce the host cell and culturing methods required to produce the antibody polypeptides from said host cells all include conventional techniques. Although preferably the cell line used to produce the antibody is a mammalian cell line, any other suitable cell line, such as a bacterial cell line such as an *E. coli*-derived bacterial strain, or a yeast cell line, may alternatively be used.

Similarly, once produced the antibody polypeptides may be purified according to standard procedures in the art, such as for example cross-flow filtration, ammonium sulphate precipitation, affinity column chromatography and the like.

The antibody polypeptides described herein may also be used for the design and synthesis of either peptide or non-peptide mimetics that would be useful for the same therapeutic applications as the antibody polypeptides of the invention. See, for example, Saragobi et al, Science, 253:792-795 (1991), the contents of which is herein incorporated by reference in its entirety.

Screening Assays

The invention also includes screening assays designed to assist in the identification of diseases and disorders associated with PCSK9 in patients exhibiting symptoms of a PCSK9 associated disease or disorder.

In some embodiments, the antibody is used as a diagnostic tool. The antibody can be used to assay the amount of PCSK9 present in a sample and/or subject. As will be appreciated by one of skill in the art, such antibodies need not be neutralizing antibodies. In some embodiments, the diagnostic antibody is not a neutralizing antibody. In some embodiments, the diagnostic antibody binds to a different epitope than the neutralizing antibody binds to. In some embodiments, the two antibodies do not compete with one another.

In some embodiments, the antibodies disclosed herein are used or provided in an assay kit and/or method for the detection of PCSK9 in mammalian tissues or cells in order to screen/diagnose for a disease or disorder associated with changes in levels of PCSK9. The kit comprises an antibody that binds PCSK9 and means for indicating the binding of the antibody with PCSK9, if present, and optionally PCSK9 protein levels. Various means for indicating the presence of an antibody can be used. For example, fluorophores, other molecular probes, or enzymes can be linked to the antibody and the presence of the antibody can be observed in a variety of ways. The method for screening for such disorders can involve the use of the kit, or simply the use of one of the disclosed antibodies and the determination of whether the antibody binds to PCSK9 in a sample. As will be appreciated by one of skill in the art, high or elevated levels of PCSK9 will result in larger amounts of the antibody binding to PCSK9 in the sample. Thus, degree of antibody binding can be used to determine how much PCSK9 is in a sample. Subjects or samples with an amount of PCSK9 that is greater than a predetermined amount (e.g., an amount or range that a person without a PCSK9 related disorder would have) can be characterized as having a PCSK9 mediated disorder. In some embodiments, the antibody is administered to a subject taking a statin, in order to determine if the statin has affected the amount of PCSK9 in the subject.

The invention is also directed to a method of in vivo imaging which detects the presence of cells which express PCSK9 comprising administering a diagnostically effective amount of a diagnostic composition. Said in vivo imaging is useful for the detection or imaging of PCSK9 expressing cells or organs, for example, and can be useful as part of a planning regimen for the design of an effective cancer treatment protocol. The treatment protocol may include, for example, one or more of radiation, chemotherapy, cytokine therapy, gene therapy, and antibody therapy, as well as an anti-PCSK9 antibody or fragment thereof.

The present invention further provides for a kit for detecting binding of an anti-PCSK9 antibody of the invention to PCSK9. In particular, the kit may be used to detect the presence of a PCSK9 specifically reactive with an anti-PCSK9 antibody of the invention or an immunoreactive fragment thereof. The kit may also include an antibody bound to a substrate, a secondary antibody reactive with the antigen and a reagent for detecting a reaction of the secondary antibody with the antigen. Such a kit may be an ELISA kit and can comprise the substrate, primary and secondary antibodies when appropriate, and any other necessary reagents such as detectable moieties, enzyme substrates, and color reagents, for example as described herein. The diagnostic kit may also be in the form of an immunoblot kit. The diagnostic kit may also be in the form of a chemiluminescent kit (Meso Scale Discovery, Gaithersburg, Md.). The diagnostic kit may also be a lanthanide-based detection kit (PerkinElmer, San Jose, Calif.).

A skilled clinician would understand that a biological sample includes, but is not limited to, sera, plasma, urine, saliva, mucous, pleural fluid, synovial fluid and spinal fluid. Methods of Ameliorating or Reducing Symptoms of or Treating, or Preventing, Diseases and Disorders Associated with, PCSK9

In another embodiment of the invention, anti-PCSK9 antibodies described herein, or fragments thereof, are useful for ameliorating or reducing the symptoms of, or treating, or preventing, diseases and disorders associated with PCSK9. Anti-PCSK9 antibodies described herein, or fragments thereof, as well as combinations, can also be administered in a therapeutically effective amount to patients in need of treatment of diseases and disorders associated with PCSK9 in the form of a pharmaceutical or diagnostic composition as described in greater detail below.

In another embodiment of the invention, anti-PCSK9 antibodies described herein, or fragments thereof, with or without a second agent, are useful for ameliorating or reducing the symptoms of, or treating, or preventing, disorders that relate to, involve, or can be influenced by varied cholesterol, LDL, or LDLR levels. In some embodiments, a "cholesterol related disorder" (which includes "serum cholesterol related disorders") includes any one or more of the following: hypercholesterolemia, heart disease, metabolic syndrome, diabetes, coronary heart disease, stroke, cardiovascular diseases, Alzheimer's disease and generally dyslipidemias, which can be manifested, for example, by an elevated total serum cholesterol, elevated LDL, elevated triglycerides, elevated VLDL, and/or low HDL. Some non-limiting examples of primary and secondary dyslipidemias that can be treated using an antibody or antibody fragment according to the invention, either alone, or in combination with one or more other agents include the metabolic syndrome, diabetes mellitus, familial combined hyperlipidemia, familial hypertriglyceridemia, familial hypercholesterolemias, including heterozygous hypercholesterolemia, homozygous hypercholesterolemia, familial defective apolipoprotein B-100; polygenic hypercholesterolemia; remnant removal disease, hepatic lipase deficiency; dyslipidemia secondary to any of the following: dietary indiscretion, hypothyroidism, drugs including estrogen and progestin therapy, beta-blockers, and thiazide diuretics; nephrotic syndrome, chronic renal failure, Cushing's syndrome, primary biliary cirrhosis, glycogen storage diseases, hepatoma, cholestasis, acromegaly, insulinoma, isolated growth hormone deficiency, and alcohol-induced hypertriglyceridemia. antibody or antibody fragment according to the invention can also be useful in preventing or treating atherosclerotic diseases, such as, for example, coronary heart disease, coronary artery disease, peripheral arterial disease, stroke (ischaemic and hemorrhagic), angina pectoris, or cerebrovascular disease and acute coronary syndrome, myocardial infarction. In some embodiments, the antibody or antibody fragment according to the invention is useful in reducing the risk of: nonfatal heart attacks, fatal and non-fatal strokes, certain types of heart surgery, hospitalization for heart failure, chest pain in patients with heart disease, and/or cardiovascular events because of established heart disease such as prior heart attack, prior heart surgery, and/or chest pain with evidence of clogged arteries. In some embodiments, the antibody or antibody fragment according to the invention and methods can be used to reduce the risk of recurrent cardiovascular events Administration In one embodiment of the invention, the anti-PCSK9 antibodies described herein, or PCSK9 binding fragments thereof, as well as combinations of said antibodies or antibody fragments, are administered to a subject at a concentration of between about 0.1 and 100.0 mg/kg of body weight of recipient subject. In a preferred embodiment of the invention, the anti-PCSK9 antibodies described herein, or PCSK9 binding fragments thereof, as well as combinations of said antibodies or antibody fragments, are administered to a subject at a concentration of about 0.4 mg/kg of body weight of recipient subject. In a preferred embodiment of the invention, the anti-PCSK9 antibodies described herein, or PCSK9 binding fragments thereof, as well as combinations of said antibodies or antibody fragments, are administered to a recipient subject with a frequency of once every twenty-six weeks or less, such as once every sixteen weeks or less, once every eight weeks or less, once every four weeks or less, once every two weeks or less, once every week or less, or once daily or less.

Fab fragments may be administered every two weeks or less, every week or less, once daily or less, multiple times per day, and/or every few hours. In one embodiment of the invention, a patient receives Fab fragments of 0.1 mg/kg to 40 mg/kg per day given in divided doses of 1 to 6 times a day, or in a sustained release form, effective to obtain desired results.

It is to be understood that the concentration of the antibody or Fab administered to a given patient may be greater or lower than the exemplary administration concentrations set forth above.

A person of skill in the art would be able to determine an effective dosage and frequency of administration through routine experimentation, for example guided by the disclosure herein and the teachings in Goodman, L. S., Gilman, A., Brunton, L. L., Lazo, J. S., & Parker, K. L. (2006). Goodman & Gilman's the pharmacological basis of therapeutics. New York: McGraw-Hill; Howland, R. D., Mycek, M. J., Harvey, R. A., Champe, P. C., & Mycek, M. J. (2006). Pharmacology. Lippincott's illustrated reviews. Philadelphia: Lippincott Williams & Wilkins; and Golan, D. E. (2008). Principles of pharmacology: the pathophysiologic basis of drug therapy. Philadelphia, Pa., [etc.]: Lippincott Williams & Wilkins.

In another embodiment of the invention, the anti-PCSK9 antibodies described herein, or PCSK9 binding fragments thereof, as well as combinations of said antibodies or antibody fragments, are administered to a subject in a pharmaceutical formulation.

A "pharmaceutical composition" refers to a chemical or biological composition suitable for administration to a mammal. Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal. In addition, administration can occur by means of injection, powder, liquid, gel, drops, or other means of administration.

In one embodiment of the invention, the anti-PCSK9 antibodies described herein, or PCSK9 binding fragments thereof, as well as combinations of said antibodies or antibody fragments, may be optionally administered in combination with one or more active agents. Such active agents include analgesic, anti-histamine, antipyretic, anti-inflammatory, antibiotic, antiviral, and anti-cytokine agents. Active agents include agonists, antagonists, and modulators of TNF-α, IL-2, IL-4, IL-6, IL-10, IL-12, IL-13, IL-18, IFN-α, IFN-γ, BAFF, CXCL13, IP-10, VEGF, EPO, EGF, HRG, Hepatocyte Growth Factor (HGF), Hepcidin, including antibodies reactive against any of the foregoing, and antibodies reactive against any of their receptors. Active agents also include but are not limited to 2-Arylpropionic acids, Aceclofenac, Acemetacin, Acetylsalicylic acid (Aspirin), Alclofenac, Alminoprofen, Amoxiprin, Ampyrone, Arylalkanoic acids, Azapropazone, Benorylate/Benorilate, Benoxaprofen, Bromfenac, Carprofen, Celecoxib, Choline magnesium salicylate, Clofezone, COX-2 inhibitors, Dexibuprofen, Dexketoprofen, Diclofenac, Diflunisal, Droxicam, Ethenzamide, Etodolac, Etoricoxib, Faislamine, fenamic acids, Fenbufen, Fenoprofen, Flufenamic acid, Flunoxaprofen, Flurbiprofen, Ibuprofen, Ibuproxam, Indometacin, Indoprofen, Kebuzone, Ketoprofen, Ketorolac, Lornoxicam, Loxoprofen, Lumiracoxib, Magnesium salicylate, Meclofenamic acid, Mefenamic acid, Meloxicam, Metamizole, Methyl salicylate, Mofebutazone, Nabumetone, Naproxen, N-Arylanthranilic acids, Nerve Growth Factor (NGF), Oxametacin, Oxaprozin, Oxicams, Oxyphenbutazone, Parecoxib, Phenazone, Phenylbutazone, Phenylbutazone, Piroxicam, Pirprofen, profens, Proglumetacin, Pyrazolidine derivatives, Rofecoxib, Salicyl salicylate, Salicylamide, Salicylates, Substance P, Sulfinpyrazone, Sulindac, Suprofen, Tenoxicam, Tiaprofenic acid, Tolfenamic acid, Tolmetin, and Valdecoxib.

An anti-histamine can be any compound that opposes the action of histamine or its release from cells (e.g., mast cells). Anti-histamines include but are not limited to acrivastine, astemizole, azatadine, azelastine, betatastine, brompheniramine, buclizine, cetirizine, cetirizine analogues, chlorpheniramine, clemastine, CS 560, cyproheptadine, desloratadine, dexchlorpheniramine, diphenhydramine, ebastine, epinastine, fexofenadine, HSR 609, hydroxyzine, levocabastine, loratidine, methscopolamine, mizolastine, norastemizole, phenindamine, promethazine, pyrilamine, terfenadine, and tranilast.

Antibiotics include but are not limited to Amikacin, Aminoglycosides, Amoxicillin, Ampicillin, Ansamycins, Arsphenamine, Azithromycin, Azlocillin, Aztreonam, Bacitracin, Carbacephem, Carbapenems, Carbenicillin, Cefaclor, Cefadroxil, Cefalexin, Cefalothin, Cefalotin, Cefamandole, Cefazolin, Cefdinir, Cefditoren, Cefepime, Cefixime, Cefoperazone, Cefotaxime, Cefoxitin, Cefpodoxime, Cefprozil, Ceftazidime, Ceftibuten, Ceftizoxime, Ceftobiprole, Ceftriaxone, Cefuroxime, Cephalosporins, Chloramphenicol, Cilastatin, Ciprofloxacin, Clarithromycin, Clindamycin, Cloxacillin, Colistin, Co-trimoxazole, Dalfopristin, Demeclocycline, Dicloxacillin, Dirithromycin, Doripenem, Doxycycline, Enoxacin, Ertapenem, Erythromycin, Ethambutol, Flucloxacillin, Fosfomycin, Furazolidone, Fusidic acid, Gatifloxacin, Geldanamycin, Gentamicin, Glycopeptides, Herbimycin, Imipenem, Isoniazid, Kanamycin, Levofloxacin, Lincomycin, Linezolid, Lomefloxacin, Loracarbef, Macrolides, Mafenide, Meropenem, Meticillin, Metronidazole, Mezlocillin, Minocycline, Monobactams, Moxifloxacin, Mupirocin, Nafcillin, Neomycin, Netilmicin, Nitrofurantoin, Norfloxacin, Ofloxacin, Oxacillin, Oxytetracycline, Paromomycin, Penicillin, Penicillins, Piperacillin, Platensimycin, Polymyxin B, Polypeptides, Prontosil, Pyrazinamide, Quinolones, Quinupristin, Rifampicin, Rifampin, Roxithromycin, Spectinomycin, Streptomycin, Sulfacetamide, Sulfamethizole, Sulfanilimide, Sulfasalazine, Sulfisoxazole, Sulfonamides, Teicoplanin, Telithromycin, Tetracycline, Tetracyclines, Ticarcillin, Timidazole, Tobramycin, Trimethoprim, Trimethoprim-Sulfamethoxazole, Troleandomycin, Trovafloxacin, and Vancomycin.

Active agents also include Aldosterone, Beclometasone, Betamethasone, Corticosteroids, Cortisol, Cortisone acetate, Deoxycorticosterone acetate, Dexamethasone, Fludrocortisone acetate, Glucocorticoids, Hydrocortisone, Methylprednisolone, Prednisolone, Prednisone, Steroids, and Triamcinolone. Any suitable combination of these active agents is also contemplated.

A "pharmaceutical excipient" or a "pharmaceutically acceptable excipient" is a carrier, usually a liquid, in which an active therapeutic agent is formulated. In one embodiment of the invention, the active therapeutic agent is a humanized antibody described herein, or one or more fragments thereof. The excipient generally does not provide any pharmacological activity to the formulation, though it may provide chemical and/or biological stability, and release characteristics. Exemplary formulations can be found, for example, in Remington's Pharmaceutical Sciences, 19$^{th}$ Ed., Grennaro, A., Ed., 1995 which is incorporated by reference.

As used herein "pharmaceutically acceptable carrier" or "excipient" includes any and all solvents, dispersion media, coatings, antibacterial and antifungal agents, isotonic and absorption delaying agents that are physiologically compatible. In one embodiment, the carrier is suitable for parenteral administration. Alternatively, the carrier can be suitable for intravenous, intraperitoneal, intramuscular, or sublingual administration. Pharmaceutically acceptable carriers include sterile aqueous solutions or dispersions and sterile powders for the extemporaneous preparation of sterile injectable solutions or dispersions. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions.

Pharmaceutical compositions typically must be sterile and stable under the conditions of manufacture and storage. The invention contemplates that the pharmaceutical composition is present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The invention further contemplates the inclusion of a stabilizer in the pharmaceutical composition. The proper fluidity can be maintained, for example, by the maintenance of the required particle size in the case of dispersion and by the use of surfactants.

In many cases, it will be preferable to include isotonic agents, for example, sugars, polyalcohols such as mannitol or sorbitol, or sodium chloride in the composition. Prolonged absorption of the injectable compositions can be brought about by including in the composition an agent which delays absorption, for example, monostearate salts and gelatin. Moreover, the alkaline polypeptide can be formulated in a time release formulation, for example in a composition which includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are known to those skilled in the art.

For each of the recited embodiments, the compounds can be administered by a variety of dosage forms. Any biologically-acceptable dosage form known to persons of ordinary skill in the art, and combinations thereof, are contemplated. Examples of such dosage forms include, without limitation, reconstitutable powders, elixirs, liquids, solutions, suspensions, emulsions, powders, granules, particles, microparticles, dispersible granules, cachets, inhalants, aerosol inhalants, patches, particle inhalants, implants, depot implants, injectables (including subcutaneous, intramuscular, intravenous, and intradermal), infusions, and combinations thereof.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The teachings provided herein of the invention can be applied to other purposes, other than the examples described above.

These and other changes can be made to the invention in light of the above detailed description. In general, in the following claims, the terms used should not be construed to limit the invention to the specific embodiments disclosed in the specification and the claims. Accordingly, the invention is not limited by the disclosure, but instead the scope of the invention is to be determined entirely by the following claims.

The invention may be practiced in ways other than those particularly described in the foregoing description and examples. Numerous modifications and variations of the invention are possible in light of the above teachings and, therefore, are within the scope of the appended claims.

Certain teachings related to humanization of rabbit-derived monoclonal antibodies and preferred sequence modifications to maintain antigen binding affinity were disclosed in International Application No. PCT/US2008/064421, corresponding to International Publication No. WO/2008/144757, entitled "Novel Rabbit Antibody Humanization Methods and Humanized Rabbit Antibodies", filed May 21, 2008, the disclosure of which is herein incorporated by reference in its entirety.

Certain teachings related to producing antibodies or fragments thereof using mating competent yeast and corresponding methods were disclosed in U.S. patent application Ser. No. 11/429,053, filed May 8, 2006, (U.S. Patent Application Publication No. US2006/0270045), the disclosure of which is herein incorporated by reference in its entirety.

Certain PCSK9 antibody polynucleotides and polypeptides are disclosed in the sequence listing accompanying this patent application filing, and the disclosure of said sequence listing is herein incorporated by reference in its entirety.

The entire disclosure of each document cited (including patents, patent applications, journal articles, abstracts, manuals, books, or other disclosures) in the Background of the Invention, Detailed Description, and Examples is herein incorporated by reference in their entireties.

The following examples are put forth so as to provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight, temperature is in degrees centigrade; and pressure is at or near atmospheric.

EXAMPLES

Example 1

Preparation of Antibodies that Bind PCSK9

By using an antibody selection protocol substantially as described herein, a panel of antibodies specific to PCSK9 were produced.

Immunization Strategy

Rabbits were immunized with human PCSK9 (R&D and in house produced). Immunization consisted of a first subcutaneous (sc) injection of 100 µg of antigen in complete Freund's adjuvant (CFA) (Sigma) followed by two boosts, two weeks apart each containing 50 µg antigen mixed with 50 µg in incomplete Freund's adjuvant (IFA) (Sigma). Animals were bled on day 55, and serum titers were determined by ELISA (antigen recognition).

Additional immunizations were performed with repetitive immunizations in multiple sites. Animals were given either a high or low dose of antigen on the following schedule: initial dose (400 µg or 100 µg) on Day 1 with boosts (200 µg or 50 µg) on Days 3, 6, 9, and 12. Tissue harvest was performed on Day 13.

Antibody Selection Titer Assessment

To identify and characterize antibodies that bind to human PCSK9, antibody-containing solutions were tested by ELISA. Briefly, neutravidin coated plates (Thermo Scientific), were coated with biotinylated human PCSK9 (504, per well, 1 µg/mL) diluted in PBS for approximately 1 hr at room temperature or alternatively overnight at 4° C. The plates were then blocked with ELISA buffer for one hour at room temperature and washed using wash buffer (PBS, 0.05% tween 20). Serum samples tested were serially diluted using ELISA buffer (0.5% fish skin gelatin in PBS pH 7.4). Fifty microliters of diluted serum samples were transferred onto the wells and incubated for one hour at room temperature for one hour. After this incubation, the plate was washed with wash buffer. For development, an anti-rabbit specific Fc-HRP (1:5000 dilution in ELISA buffer) was added onto the wells and incubated for 45 min at RT. After a 3× wash step with wash solution, the plate was developed using TMB substrate for two minutes at room temperature and the reaction was quenched using 0.5M HCl. The well absorbance was read at 450 nm.

Tissue Harvesting

Once acceptable titers were established, the rabbit(s) were sacrificed. Spleen, lymph nodes, and whole blood were harvested and processed as follows:

Spleen and lymph nodes were processed into a single cell suspension by disassociating the tissue and pushing through sterile wire mesh at 70 µm (Fisher) with a plunger of a 20 cc syringe. Cells were collected in PBS. Cells were washed twice by centrifugation. After the last wash, cell density was determined by trypan blue. Cells were centrifuged at 1500 RPM for 10 minutes; the supernatant was discarded. Cells were resuspended in the appropriate volume of 10% dimethyl sulfoxide (DMSO, Sigma) in FBS (Hyclone) and dispensed at 1 mL/vial. Vials were stored at −70° C. in a slow freezing chamber for 24 hours and stored in liquid nitrogen.

B Cell Selection, Enrichment and Culture Conditions

On the day of setting up B cell cultures, PBMC, splenocyte, or lymph node vials were thawed for use. Vials were removed from LN2 tank and placed in a 37° C. water bath until thawed. Contents of vials were transferred into 15 mL conical centrifuge tube (Corning) and 10 mL of modified RPMI described above was slowly added to the tube. Cells were centrifuged for 5 minutes at 2K RPM, and the supernatant was discarded. Cells were resuspended in 10 mL of fresh media. Cell density and viability was determined by trypan blue.

Biotinylated human PCSK9 was pre-loaded onto the streptavidin beads as follows. Seventy five microliters of streptavidin beads (Milteny Biotec, Auburn Calif.) were mixed with N-terminally biotinylated huPCSK9 (10 µg/mL final concentration) and 300 µl PBF. This mixture was incubated at 4° C. for 30 min and unbound biotinylated human PCSK9 was removed using a MACS® separation column (Miltenyi Biotec, with a 1 ml rinse to remove unbound material. Then material was plunged out, then used to resuspend cells from above in 100 µL per 1E7 cells, the mixture was then incubated at 4° C. for 30 min and washed once with 10 mL of PBF. After washing, the cells were resuspended in 500 µL of PBF and set aside. A MACS® MS column (Miltenyi Biotec, Auburn Calif.) was pre-rinsed with 500 mL of PBF on a magnetic stand (Milteni). Cell suspension was applied to the column through a pre-filter, and unbound fraction was collected. The column was washed with 2.5 mL of PBF buffer. The column was removed from the magnet stand and placed onto a clean, sterile 1.5 mL eppendorf tube. 1 mL of PBF buffer was added to the top of the column, and positive selected cells were collected. The yield and viability of positive cell fraction was determined by trypan blue staining. Positive selection yielded an average of 1% of the starting cell concentration.

A pilot cell screen was established to provide information on seeding levels for the culture. Plates were seeded at 10, 25, 50, 100, or 200 enriched B cells/well. In addition, each well contained 25-50K cells/well of irradiated EL-4.B5 cells (5,000 Rads) and an appropriate level of activated rabbit T cell supernatant (See U.S. Patent Application Publication No. 20070269868) (ranging from 1-5% depending on preparation) in high glucose modified RPMI medium at a final volume of 250 µL/well. Cultures were incubated for 5 to 7 days at 37° C. in 4% $CO_2$.

B-Cell Culture Screening by Antigen-Recognition (ELISA)

To identify wells producing anti-human PCSK9 antibodies, the same protocol as described for titer determination of serum samples by antigen-recognition (ELISA) was used with the following changes. Briefly, neutravidin coated plates were coated with biotinylated human PCSK9 (504 per well, 1 µg/mL each). B-cell supernatant samples (50 µL) were tested without prior dilution.

Identification of Functional Activity in B-Cell Supernatants Using One or More Assays Following identification by antigen-recognition ELISA, antibodies targeting the function modifying epitopes of PCSK9 were identified using a PCSK9 blocking ELISA. Biotinylated PCSK9 was coated on to streptavidin plates and then a pool of recombinant, function modifying anti-PCSK9 antibodies (in house generated) with human Fc regions were used to block functional epitopes. Once the epitopes were blocked, B-cell culture supernatants were put on the wells and antibody binding detected by anti-rabbit Fc-HRP (Jackson ImmunoResearch).

Amplification and Sequence Determination of Antibody Sequences from Antigen-Specific B Cells After effecting functional assays to identify B cell supernatants containing anti-PCSK9 antibodies possessing desired functional properties, antigen-specific B cells secreting these antibodies were then isolated. The antibody sequences were thereafter recovered from these isolated B cells using a combined RT-PCR based method that isolates antibody sequences from a single isolated B-cell. Primers containing restriction enzyme recognition sites were designed to anneal in conserved and constant regions of the target immunoglobulin genes (heavy and light), such as rabbit immunoglobulin sequences, and a two-step nested PCR recovery was used to amplify the antibody sequence. Amplicons from each well were analyzed for recovery and size integrity. The resulting fragments are then digested with AluI to fingerprint the sequence clonality. Identical sequences displayed a common fragmentation pattern in their electrophoretic analysis. The original heavy and light chain amplicon fragments were then digested using the restriction enzyme sites contained within the PCR primers and cloned into an expression vector. Vector containing subcloned DNA fragments were amplified and purified. Sequence of the subcloned heavy and light chains were verified prior to expression.

Recombinant Production of Monoclonal Antibody of Desired Antigen Specificity and/or Functional Properties To determine antigen specificity and functional properties of recovered antibodies from specific B-cells, vectors driving the expression of the desired paired heavy and light chain sequences were transfected into HEK-293 cells.

Antigen-Recognition of Recombinant Antibodies by ELISA

To characterize recombinant expressed antibodies for their ability to bind to human PCSK9, antibody-containing solutions were tested by ELISA. All incubations were done at room temperature. Briefly, Neutravidin plates (Pierce) were blocked for 1 hr with ELISA buffer (PBS, 0.5% fish skin gelatin, 0.05% Tween-20). After blocking, plates were coated with a biotinylated-PCSK9 containing solution (1 µg/mL in ELISA buffer) for 1 hour. PCSK9-coated plates were then washed three times in wash buffer (PBS, 0.05% Tween-20). After coating, the plates were blocked again with ELISA buffer for 1 hour. The blocking solution was removed and the plates were then incubated with a dilution series of the antibody being tested for approximately one hour. At the end of this incubation, the plate was washed three times with wash buffer and further incubated with a secondary antibody containing solution (Peroxidase conjugated affinipure F(ab')2 fragment goat anti-human IgG, Fc fragment specific [Jackson Immunoresearch]) for approximately 45 minutes and washed three times. Next a substrate solution (TMB peroxidase substrate, BioFx) was added and incubated for 3 to 5 minutes in the dark. The reaction was stopped by addition of 0.5M HCl and the plate was read at 450 nm in a plate-reader.

Results: FIGS. 13-26 demonstrate that anti-PCSK9 antibodies Ab1-Ab24 bind to and recognize human PCSK9.

Functional Characterization of Recombinant Antibodies by Modulation of LDL-C Uptake by HepG2 Cells The ability of anti-PCSK9 antibodies to neutralize the inhibition of LDL-C uptake in HepG2 cells by PCSK9 was tested in a cell-based assay. HepG2 cells were seeded (30,000 cells/well) in a collagen coated 96 well plate. Twenty-four hours later, the media was replaced with fresh media containing 0.5% low lipid FBS. Various concentrations of anti-PCSK9 antibodies were incubated with 3 μg/mL PCSK9 for 1 hour at room temperature and then added to the HepG2 cells and incubated for 5 hours at 37° C. BODIPY-LDL was added to each well and incubated overnight at 37° C. The media was removed and the cells lysed with RIPA buffer and the amount of BODIPY-LDL taken up by the cells measured on a plate reader (excitation, 485 nm; emission 535 nm).

Results: FIGS. 27-46 demonstrate that anti-PCSK9 antibodies neutralize the ability of PCSK9 to inhibit LDL-C uptake.

Cynomolgus Monkey Antigen-Recognition of Recombinant Antibodies by ELISA

To characterize recombinant expressed antibodies for their ability to bind to cynomolgus monkey PCSK9, antibody-containing solutions were tested by ELISA. Procedure was as described for human PCSK9 ELISA except cynomolgus PCSK9 was utilized.

Results: FIGS. 47-60 demonstrate that anti-PCSK9 antibodies bind and recognize cynomolgus monkey PCSK9.

Example 2

Yeast Cell Expression

Construction of *Pichia pastoris* Expression Vectors for Heavy and Light Chain

The humanized light and heavy chain fragments were commercially synthesized and subcloned into a pGAP expression vector. The pGAP expression vector uses the GAP promoter to drive expression of the immunoglobulin chain and a secretion leader sequence for export. In addition, this vector contains common elements such as a bacterial origin of replication, and a copy of the kanamycin resistance gene which confers resistance to the antibiotic G418 in *P. pastoris*. G418 provides a means of selection for strains that contain the desired expression vector integrated into their genome.

Transformation of Expression Vectors into Haploid Met1 and Lys3 Host Strains of *Pichia pastoris*

All methods used for transformation of haploid *P. pastoris* strains and manipulation of the *P. pastoris* sexual cycle were done as described in *Pichia* Protocols (Methods in Molecular Biology Higgings, D R, and Cregg, J M, Eds. 1998. Humana Press, Totowa, N.J.). Prior to transformation each vector was linearized within the GAP promoter sequences to direct the integration of the vector into the GAP promoter locus of the *P. pastoris* genome. Haploid strains were transfected using electroporation and successful transformants were selected on YPDS (yeast extract, peptone dextrose with sorbitol) G418 agar plates. Copy numbers of heavy and light chain genes were determined for haploid strains by Southern blot analysis. Haploid strains were then mated and selected for their ability to grow in the absence of the amino acid markers (i.e., Lys and Met). Resulting diploid clones were then subjected to a final Southern blot to confirm copy numbers of heavy and light chain genes. A clone expressing the antibody of interest was selected using biolayer interferometry Protein-A biosensors to monitor expression (Octet, ForteBio). Dual locus strains were generated using the methods disclosed in U.S. Application No. 61/525,307, the contents of which are incorporated by reference in its entirety.

Example 3

Expression of Ab18 in *Pichia pastoris*

*Pichia* strains for expression of full-length antibody were made. For all the full length antibody expressing strains, haploids strains were created and subsequently mated. One haploid strain expressed full-length light chain sequence and another haploid strain expressed the full-length heavy chain sequence. Each diploid strain was used to generate a research cell bank and used for expression in a bioreactor.

First an inoculum was expanded using the research cell bank using medium comprised of the following nutrients (% w/v): yeast extract 3%, anhydrous dextrose 4%, YNB 1.34%, Biotin 0.004% and 100 mM potassium phosphate. To generate the inoculum for the fermenters, the cell bank was expanded for approximately 24 hours in a shaking incubator at 30° C. and 300 RPM. A 10% inoculum was then added to Labfors 2.5 L working volume vessels containing 1 L sterile growth medium. The growth medium was comprised of the following nutrients: potassium sulfate 18.2 g/L, ammonium phosphate monobasic 36.4 g/L, potassium phosphate dibasic 12.8 g/L, magnesium sulfate heptahydrate 3.72 g/L, sodium citrate dihydrate 10 g/L, glycerol 40 g/L, yeast extract 30 g/L, PTM1 trace metals 4.35 mL/L, and antifoam 204 1.67 mL/L. The PTM1 trace metal solution was comprised of the following components: cupric sulfate pentahydrate 6 g/L, sodium iodide 0.08 g/L, manganese sulfate hydrate 3 g/L, sodium molybdate dehydrate 0.2 g/L, boric acid 0.02 g/L, cobalt chloride 0.5 g/L, zinc chloride 20 g/L, ferrous sulfate heptahydrate 65 g/L, biotin 0.2 g/L, and sulfuric acid 5 mL/L.

The bioreactor process control parameters were set as follows: Agitation 1,000 RPM, airflow 1.35 standard liter per minute, temperature 28° C. and pH was controlled at six using ammonium hydroxide. No oxygen supplementation was provided.

Fermentation cultures were grown for approximately 12 to 16 hours until the initial glycerol was consumed as denoted by a dissolved oxygen spike. The cultures were starved for approximately three hours after the dissolved oxygen spike. After this starvation period, a bolus addition of ethanol was added to the reactor to reach 1% ethanol (w/v). The fermentation cultures were allowed to equilibrate for 15 to 30 minutes. Feed addition was initiated 30 minutes post-ethanol bolus and set at a constant rate of 1 mL/min for 40 minutes, then the feed pump was controlled by an ethanol sensor keeping the concentration of ethanol at 1% for the remainder of the run using an ethanol sensing probe (Raven Biotech). The feed was comprised of the following components: yeast extract 50 g/L, dextrose 500 g/L, magnesium sulfate heptahydrate 3 g/L, and PTM1 trace metals 12 mL/L. The total fermentation time was approximately 90 hours.

Example 4

Methods of Humanizing Antibodies

Methods of humanizing antibodies have been described previously in issued U.S. Pat. No. 7,935,340, the disclosure of which is incorporated herein by reference in its entirety. In some instances, a determination of whether additional rabbit framework residues are required to maintain activity is necessary. In some instances the humanized antibodies still requires some critical rabbit framework residues to be retained to minimize loss of affinity or activity. In these cases, it is necessary to change single or multiple framework amino acids from human germline sequences back to the original rabbit amino acids in order to have desired activity. These changes are determined experimentally to identify which rabbit residues are necessary to preserve affinity and activity.

Example 5

Binding Affinities of Anti-PCSK9 Antibodies

Binding affinities of monoclonal antibodies for PCSK9 were estimated using Bio-Layer Interferometry (BLI) on the Octet QK (ForteBio). Biotinylated antibody was immobilized at different densities to the surface of Streptavidin (SA) Biosensors. A dilution series of human PCSK9 prepared in 1× Kinetics Buffer (NaCl 0.0138 M; KCl 0.00027 M; 0.1 mg/mL BSA, 0.002% Tween and 0.005% Sodium Azide; pH 7.4, at 25° C.) purchased from the manufacturer (ForteBio) was used to query the antibodies. At our chosen concentrations of antigen (~0.25 μg/mL-2 μg/mL) association times of 15 minutes and dissociation times of 25 minutes were used with the Octet Analysis Software (v6.4, ForteBio), to globally fit data using a 1:1 Langmuir binding model. This technique does not allow for sensor regeneration and each antibody tested requires a unique set of sensors. Examples of antibody affinities are listed in Table 1.

TABLE 1

| Antibody | $K_D$ (pM) | $k_{on}$ (1/Ms) | $k_{dis}$ (1/s) |
|---|---|---|---|
| Ab1 | 7990 | 1.62E+05 | 1.30E−03 |
| Ab2 | 4250 | 1.07E+05 | 4.53E−04 |
| Ab3 | 5870 | 9.44E+04 | 5.54E−04 |
| Ab4 | 6000 | 7.03E+04 | 4.22E−04 |
| Ab5 | 3160 | 8.81E+04 | 2.78E−04 |
| Ab6 | 531 | 7.53E+04 | 4.00E−05 |
| Ab7 | 379 | 7.07E+04 | 2.68E−05 |
| Ab8 | 637 | 7.70E+04 | 4.91E−05 |
| Ab9 | 637 | 7.70E+04 | 4.91E−05 |
| Ab10 | 676 | 7.53E+04 | 5.09E−05 |
| Ab11 | 332 | 6.68E+04 | 2.22E−05 |
| Ab12 | 120 | 1.00E+05 | 1.21E−05 |
| Ab13 | 2230 | 1.59E+05 | 3.53E−04 |
| Ab14 | 3700 | 9.79E+04 | 3.62E−04 |
| Ab15 | 839 | 6.92E+04 | 5.80E−05 |
| Ab16 | 1280 | 7.75E+04 | 9.92E−05 |
| Ab17 | 609 | 1.03E+05 | 6.27E−05 |
| Ab18 | 215 | 9.70E+04 | 2.09E−05 |
| Ab19 | 1300 | 8.80E+04 | 1.16E−04 |
| Ab20 | 600 | 1.08E+05 | 6.63E−05 |

Binding Affinities of Anti-PCSK9 Antibodies Using SPR (Ab21-24)

Binding affinities of monoclonal antibodies for PCSK9 were estimated using Surface Plasmon Resonance (SPR) on the ProteOn XPR36 (Bio-Rad). Biotinylated antibody was immobilized at progressively increasing densities to the surface of Neutravidin (NLC) Chips. A dilution series of human PCSK9 prepared in 1×HBS-EP+Buffer (10 mM Hepes; 150 mM NaCl; 3 mM EDTA, 0.05% Polysorbate 20; pH 7.6 at 25° C.) purchased from Thermo Scientific and supplemented with 0.2 mg/mL Bovine Serum Albumin (BSA) from Jackson ImmunoResearch and 0.005% sodium azide from VWR was used to query the antibodies. At our chosen concentrations of antigen (~0.08 μg/mL-6.7 μg/mL) association times of 4 minutes and dissociation times of 30-120 minutes were used with the ProteOn Manager Software (v3.1.0.6, Bio-Rad) to group and fit data using a 1:1 Langmuir binding model. Surfaces were regenerated between analyte queries and after binding antibody to the surface using 10 mM Glycine pH 2.0. Data across 4 different densities were averaged and a single $K_D$ and standard propagation of error calculated for each antibody. These values are reported in Table 2.

TABLE 2

| Antibody | $K_D$ (M) | AVG hu $k_d$ (1/s) | AVG hu $k_a$ (1/Ms) |
|---|---|---|---|
| Ab21 | 6.1E−10 | 3.54E−04 | 5.80E+05 |
| Ab22 | 4.9E−10 | 2.59E−04 | 5.29E+05 |
| Ab23 | 4.0E−11 | 3.71E−05 | 9.28E+05 |
| Ab24 | 9.0E−11 | 6.16E−05 | 6.84E+05 |

Example 6

PCSK9 Antibodies Inhibit PCSK9 Interaction with LDLR

The ability of the panel of anti-PCSK9 antibodies to block the interaction of PCSK9 with LDLR was evaluated with an ELISA based immunoassay. Briefly, LDLR (0.5 m/mL) was coated on 4HBX plates overnight at 4° C. The plates were blocked with 0.5% fish skin gelatin in PBS, pH 7.4 for 1 hour at room temperature followed by 3 washes with PBS. Biotinylated PCSK9 (0.3 μg/ml) was incubated in the presence of serial dilutions of anti-PCSK9 antibodies at room temperature for 1 hour and then added to the LDLR coated plates. After incubation for 1 hour at room temperature, plates were washed (3× with PBS). For development, streptavidin-HRP was added, incubated for 1 hour at room temperature, washed (3× in PBS) and TMB substrated added for 3 minutes at room temperature. The reaction was quenched using 0.5M HCl and absorbance read at 450 nm.

Results: FIGS. 61-84 demonstrates anti-PCSK9 antibodies block PCSK9 interaction with LDLR.

Example 7

Anti-PCSK9 Antibody Lowers Plasma LDL-C Levels in Non-Human Primates

A pharmacodynamic (PD) and pharmacokinetic (PK) study was conducted in naïve male cynomolgus monkeys aged 3-4 years and weights of 3-4 kg.

Three cynomolgus monkeys were injected with vehicle (15 mM histidine, 250 mM sorbitol, pH 5.5) and three monkeys were injected with Ab18 (5 mg/kg). Injections were performed by IV bolus administered on day 1.

Blood was collected by venipuncture and processed to serum for clinical chemistry. Blood was collected in $K_3$EDTA tubes and processed to plasma for PK analyses. Blood samples were collected for clinical chemistry from fasted animals pre-injection, 24 hours post injection and then every third day to day 30. Blood samples for PK analysis were collected pre-injection, 5 min, 30 min, 1 hr, 2 hr, 4 hr, 8 hr, 12, hr, 18 hr, 24, hr 36 hr, 48, hr, 96 hr and then every 3 days to day 30. All samples were stored at −70° C. or below.

Clinical chemistry analyses included the following parameters: alanine aminotransferase, aspartate aminotransferase, alkaline phosphatase, gamma-glutamyltransferase, lactate dehydrogenase, total bilirubin, urea nitrogen, C-reactive protein, calcium, creatinine, phosphorus, low density lipoprotein, high density lipoprotein, total protein, albumin, globulin, albumin/globulin ratio, glucose, cholesterol, triglycerides, sodium, potassium, chloride, and bicarbonate.

Results: FIG. 85 demonstrates that Ab18 resulted in a reduction of LDL-C levels up to 60% over a 14 day period. LDL-C levels subsequently return rapidly to predose levels. Following injection of Ab18 on day 30 a similar decrease on LDL-C levels was observed. A 20-25% reduction in cholesterol was observed (FIG. 86) while HDL-C levels remained unchanged (FIG. 87).

Total antibody levels were determined by ELISA. Briefly, Multi-Array 96 well High Bind plates were coated with 0.5 m/mL goat anti-Human IgG (monkey adsorbed) overnight at 4° C. Plates were blocked with 3% Blocker A in PBS+0.5% Tween 20 for 1 hour at room temperature. Plates were washed (3× in PBS+0.5% Tween) and sample added followed by a 1 hour incubation at room temperature. Plates were washed 3 times and Ab18 detected with biotinylated human heavy/light chain antibody and sulfo-TAG strepavadin. Plates were washed 3 times and read with MSD.

Results: Table 3 shows results in three cynomolgus monkeys of total antibody levels

TABLE 3

| Animal | $C_{max}$ (mg/ml) | $T_{max}$ (h) | $T_{1/2}$ (h) |
|---|---|---|---|
| 1 | 72.93 | 4 | 71.35 |
| 2 | 110.35 | 4 | 63.46 |
| 3 | 98.99 | 4 | 69.01 |

Example 8

Anti-PCSK9 Antibody Lowers Plasma LDL-C Levels in Non-Human Primates

A pharmacodynamic (PD) study was conducted in male cynomolgus monkeys aged 3-4 years and weights of 3-4.5 kg.

Three cynomolgus monkeys were injected with Ab11 (5 mg/kg). Injections were performed by IV bolus administered on day 1.

Blood was collected by venipuncture and processed to serum for clinical chemistry. Blood was collected in K3EDTA tubes and processed to plasma for PK analyses. Blood samples were collected for clinical chemistry from fasted animals pre-injection, 24 hours post injection and then every third day. Blood samples for PK analysis were collected pre-injection, 5 min, 30 min, 1 hr, 2 hr, 4 hr, 8 hr, 12, hr, 18 hr, 24, hr 36 hr, 48, hr, 96 hr, 168 hr, 240 hr, 312 hr, 384 hr, 528 hr, and 696 hr. All samples were stored at −70° C. or below.

Clinical chemistry analyses included the following parameters: alanine aminotransferase, aspartate aminotransferase, alkaline phosphatase, gamma-glutamyltransferase, lactate dehydrogenase, total bilirubin, urea nitrogen, C-reactive protein, calcium, creatinine, phosphorus, low density lipoprotein, high density lipoprotein, total protein, albumin, globulin, albumin/globulin ratio, glucose, cholesterol, triglycerides, sodium, potassium, chloride, and bicarbonate.

Results: FIG. 88 demonstrates that Ab11 resulted in a reduction of LDL-C levels up to 60% over a 16 day period. LDL-C levels subsequently returned to predose levels. A 25-30% reduction in cholesterol was observed (FIG. 89) while HDL-C levels remained unchanged (FIG. 90).

Example 9

Anti-PCSK9 Antibody Lowers Plasma LDL-C Levels in Non-Human Primates

A pharmacodynamic (PD) study was conducted in male cynomolgus monkeys aged 3-5 years and weights of 2.8-4.0 kg.

Three cynomolgus monkeys were injected with Ab19 (5 mg/kg). Injections were performed by IV bolus administered on day 1.

Blood was collected by venipuncture and processed to serum for clinical chemistry. Blood was collected in K3EDTA tubes and processed to plasma for PK analyses. Blood samples were collected for clinical chemistry from fasted animals pre-injection, 24 hours, 48 hours, and 96 hours post injection and then every third day to day 34. Blood samples for PK analysis were collected pre-injection, 5 min, 30 min, 1 hr, 2 hr, 4 hr, 8 hr, 12 hr, 24 hr, 48 hr, 96 hr, and then every third day to day 34. All samples were stored at −70° C. or below.

Clinical chemistry analyses included the following parameters: alanine aminotransferase, aspartate aminotransferase, alkaline phosphatase, gamma-glutamyltransferase, lactate dehydrogenase, total bilirubin, urea nitrogen, C-reactive protein, calcium, creatinine, phosphorus, low density lipoprotein, high density lipoprotein, total protein, albumin, globulin, albumin/globulin ratio, glucose, cholesterol, triglycerides, sodium, potassium, chloride, and bicarbonate.

Results: FIG. 91 demonstrates that Ab19 resulted in a reduction of LDL-C levels up to 65% over a 19 day period. LDL-C levels subsequently returned to predose levels.

Example 10

Anti-PCSK9 Antibody Lowers Plasma LDL-C Levels in Non-Human Primates

A pharmacodynamic (PD) study was conducted in male cynomolgus monkeys aged 3-5 years and weights of 2.8-4.0 kg.

Three cynomolgus monkeys were injected with Ab20 (5 mg/kg). Injections were performed by IV bolus administered on day 1.

Blood was collected by venipuncture and processed to serum for clinical chemistry. Blood was collected in K3EDTA tubes and processed to plasma for PK analyses. Blood samples were collected for clinical chemistry from fasted animals pre-injection, 24 hours, 48 hours, and 96 hours post injection and then every third day to day 34. Blood samples for PK analysis were collected pre-injection, 5 min, 30 min, 1 hr, 2 hr, 4 hr, 8 hr, 12 hr, 24 hr, 48 hr, 96 hr, and then every third day to day 34. All samples were stored at −70° C. or below.

Clinical chemistry analyses included the following parameters: alanine aminotransferase, aspartate aminotransferase, alkaline phosphatase, gamma-glutamyltransferase, lactate dehydrogenase, total bilirubin, urea nitrogen, C-reactive protein, calcium, creatinine, phosphorus, low density lipoprotein, high density lipoprotein, total protein, albumin, globulin, albumin/globulin ratio, glucose, cholesterol, triglycerides, sodium, potassium, chloride, and bicarbonate.

Results: FIG. 92 demonstrates that Ab20 resulted in a reduction of LDL-C levels up to 70% over a 22 day period. LDL-C levels subsequently returned to predose levels.

Example 11

Anti-PCSK9 Antibody Lowers Plasma LDL-C Levels in Non-Human Primates

A pharmacodynamic (PD) study was conducted in male cynomolgus monkeys aged 3-5 years and weights of 2.8-4.0 kg.

Three cynomolgus monkeys were injected with Ab22 and Ab24 (5 mg/kg). Injections were performed by IV bolus administered on day 1.

Blood was collected by venipuncture and processed to serum for clinical chemistry. Blood was collected in K3EDTA tubes and processed to plasma for PK analyses. Blood samples were collected for clinical chemistry from fasted animals pre-injection, 24 hours, 48 hours, and 96 hours post injection and then every third day to day 46 (Ab22) or day 37 (Ab24). Blood samples for PK analysis were collected pre-injection, 5 min, 30 min, 1 hr, 2 hr, 4 hr, 8 hr, 12 hr, 24 hr, 48 hr, 96 hr, and then every third day to day 46 (Ab22) or day 37 (Ab24). All samples were stored at −70° C. or below.

Clinical chemistry analyses included the following parameters: alanine aminotransferase, aspartate aminotransferase, alkaline phosphatase, gamma-glutamyltransferase, lactate dehydrogenase, total bilirubin, urea nitrogen, C-reactive protein, calcium, creatinine, phosphorus, low density lipoprotein, high density lipoprotein, total protein, albumin, globulin, albumin/globulin ratio, glucose, cholesterol, triglycerides, sodium, potassium, chloride, and bicarbonate.

Results: FIG. 93 demonstrates that Ab22 resulted in a reduction of LDL-C levels up to 60% over a 22 day period. LDL-C levels subsequently returned to predose levels. FIG. 94 demonstrates that Ab24 resulted in a reduction of LDL-C levels up to 70% over a 22 day period. LDL-C levels subsequently returned to predose levels.

SEQUENCE LISTING (963 sequences)

SEQ ID NO: 1 - protein, 448 aa, Artificial
  Humanized antibody sequence
QSVEESGGRLVTPGTPLTLTCTVSGFSLSSYWMTWVRQAPGKGLEYIGIISSSGSTYYATWAKGRFTISKTSSTTVDLEITSPTTEDTATYFCARDSAFSSGLEFNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 118 aa, Artificial
  Humanized antibody sequence
QSVEESGGRLVTPGTPLTLTCTVSGFSLSSYWMTWVRQAPGKGLEYIGIISSSGSTYYATWAKGRFTISKTSSTTVDLEITSPTTEDTATYFCARDSAFSSGLEFNIWGPGTLVTVSS

SEQ ID NO: 3 - protein, 29 aa, Oryctolagus cuniculus
QSVEESGGRLVTPGTPLTLTCTVSGFSLS

SEQ ID NO: 4 - protein, 5 aa, Oryctolagus cuniculus
SYWMT

SEQ ID NO: 5 - protein, 14 aa, Oryctolagus cuniculus
WVRQAPGKGLEYIG

SEQ ID NO: 6 - protein, 16 aa, Oryctolagus cuniculus
IISSSGSTYYATWAKG

SEQ ID NO: 7 - protein, 31 aa, Oryctolagus cuniculus
RFTISKTSSTTVDLEITSPTTEDTATYFCAR

SEQ ID NO: 8 - protein, 12 aa, Oryctolagus cuniculus
DSAFSSGLEFNI

SEQ ID NO: 9 - protein, 11 aa, Artificial
  Humanized antibody sequence
WGPGTLVTVSS

SEQ ID NO: 10 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 1344 bp, Artificial
  Humanized antibody sequence
cagtcggtggaggagtccgggggtcgcctggtcacgcctgggacacccctgacactcacctgcacagtctctggattctccctcagtagctactggatgacttgggtccgccaggctccagggaaggggctggaatacatcggaatcattagtagtagtggtagcacatactacgcgacctgggcgaaaggccgattcaccatctccaaaacctcgtcgaccacggtggatctggaaatcaccagtccgacaaccgaggacacggccacctatttctgtgccagagactctgcttttagttctggtttggaattcaacatctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - DNA, 354 bp, Artificial
  Humanized antibody sequence
cagtcggtggaggagtccgggggtcgcctggtcacgcctgggacacccctgacactcacctgcacagtctctggattctccctcagtagctactggatgacttgggtccgccaggctccagggaaggggctggaatacatcggaatcattagtagtagtggtagcacatactacgcgacctgggcgaaaggccgattcaccatctccaaaacctcgtcgaccacggtggatctggaaatcaccagtccgacaaccgaggacacggccacctatttctgtgccagagactctgcttttagttctggtttggaattcaacatctggggcccgggcaccctcgtcaccgtctcgagc

SEQ ID NO: 13 - DNA, 87 bp, Oryctolagus cuniculus
cagtcggtggaggagtccgggggtcgcctggtcacgcctgggacacccctgacactcacctgcacagtctctggattctccctcagt

SEQ ID NO: 14 - DNA, 15 bp, Oryctolagus cuniculus
agctactggatgact

SEQ ID NO: 15 - DNA, 42 bp, Oryctolagus cuniculus
tgggtccgccaggctccagggaaggggctggaatacatcgga

SEQ ID NO: 16 - DNA, 48 bp, Oryctolagus cuniculus
atcattagtagtagtggtagcacatactacgcgacctgggcgaaaggc

SEQ ID NO: 17 - DNA, 93 bp, Oryctolagus cuniculus
cgattcaccatctccaaaacctcgtcgaccacggtggatctggaaatcaccagtccgacaaccgaggacacggccacctatttctgtgccaga

SEQ ID NO: 18 - DNA, 36 bp, Oryctolagus cuniculus
gactctgcttttagttctggtttggaattcaacatc

SEQ ID NO: 19 - DNA, 33 bp, Artificial
  Humanized antibody sequence
tggggcccgggcaccctcgtcaccgtctcgagc

SEQ ID NO: 20 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - protein, 218 aa, Artificial
  Humanized antibody sequence
AYDLTQTPASVEVAVGGTVTIKCQASQSVYSNWLSWYQQKPGQPPKLLIYDASDLASGVPSRFKGSGSGTQFTLTISGVQCDDAATYYCQQGQSSSDIDNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 111 aa, Artificial
  Humanized antibody sequence
AYDLTQTPASVEVAVGGTVTIKCQASQSVYSNWLSWYQQKPGQPPKLLIYDASDLASGVPSRFKGSGSGTQFTLTISGVQCDDAATYYCQQGQSSSDIDNTFGGGTEVVVK

SEQ ID NO: 23 - protein, 23 aa, Oryctolagus cuniculus
AYDLTQTPASVEVAVGGTVTIKC

SEQ ID NO: 24 - protein, 12 aa, Oryctolagus cuniculus
QASQSVYSNWLS

SEQ ID NO: 25 - protein, 15 aa, Oryctolagus cuniculus
WYQQKPGQPPKLLIY

SEQ ID NO: 26 - protein, 7 aa, Oryctolagus cuniculus
DASDLAS

SEQ ID NO: 27 - protein, 32 aa, Oryctolagus cuniculus
GVPSRFKGSGSGTQFTLTISGVQCDDAATYYC

SEQ ID NO: 28 - protein, 12 aa, Oryctolagus cuniculus
QQGQSSSDIDNT

SEQ ID NO: 29 - protein, 10 aa, Artificial
  Humanized antibody sequence
FGGGTEVVVK

SEQ ID NO: 30 - protein, 107 aa, Artificial [sequence omitted]

SEQ ID NO: 31 - DNA, 654 bp, Artificial
  Humanized antibody sequence
gcctatgatctgacccagactccagcctctgtggaggtagctgtgggaggcacagtcaccatcaagtgccaggccagtcagagtgtttatagtaactggttatcctggtatcagcagaaaccagggcagcctcccaagctcctgatctatgatgcatccgatctggcatctggggtcccatcgcggttcaaaggcagtggatctgggacacagttcactctcaccatcagcggcgtgcagtgtgacgatgctgccacttactactgtcagcaggggcagagtagtagtgatattgataatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 32 - DNA, 333 bp, Artificial
  Humanized antibody sequence
gcctatgatctgacccagactccagcctctgtggaggtagctgtgggaggcacagtcaccatcaagtgccaggccagtcagagtgtttatagtaactggttatcctggtatcagcagaaaccagggcagcctcccaagctcctgatctatgatgcatccgatctggcatctggggtcccatcgcggttcaaaggcagtggatctgggacacagttcactctcaccatcagcggcgtgcagtgtgacgatgctgccacttactactgtcagcaggggcagagtagtagtgatattgataatactttcggcggagggaccgaggtggtggtcaaa

SEQ ID NO: 33 - DNA, 69 bp, Oryctolagus cuniculus
gcctatgatctgacccagactccagcctctgtggaggtagctgtgggaggcacagtcaccatcaagtgc

SEQ ID NO: 34 - DNA, 36 bp, Oryctolagus cuniculus
caggccagtcagagtgtttatagtaactggttatcc

SEQ ID NO: 35 - DNA, 45 bp, Oryctolagus cuniculus
tggtatcagcagaaaccagggcagcctcccaagctcctgatctat

SEQ ID NO: 36 - DNA, 21 bp, Oryctolagus cuniculus
gatgcatccgatctggcatct

SEQ ID NO: 37 - DNA, 96 bp, Oryctolagus cuniculus
ggggtcccatcgcggttcaaaggcagtggatctgggacacagttcactctcaccatcagcggcgtgcagtgtgacgatgctgccacttactactgt

SEQ ID NO: 38 - DNA, 36 bp, Oryctolagus cuniculus
cagcaggggcagagtagtagtgatattgataatact

SEQ ID NO: 39 - DNA, 30 bp, Artificial
  Humanized antibody sequence
ttcggcggagggaccgaggtggtggtcaaa

SEQ ID NO: 40 - DNA, 321 bp, Artificial
  Humanized antibody sequence
cgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 41 - protein, 449 aa, Artificial
  Humanized antibody sequence
QSVEESGGRLVTPGTPLTLTCTVSGFSLSSYAMSWVRQAPGKGLEWIGIIDAIDNTYYASWAKGRFTISKTSTTVDLKMTSLTTGDTATYFCARASILGYSIATGFNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 119 aa, Artificial
  Humanized antibody sequence
QSVEESGGRLVTPGTPLTLTCTVSGFSLSSYAMSWVRQAPGKGLEWIGIIDAIDNTYYASWAKGRFTISKTSTTVDLKMTSLTTGDTATYFCARASILGYSIATGFNIWGPGTLVTVSS

SEQ ID NO: 43 - protein, 29 aa, Oryctolagus cuniculus
QSVEESGGRLVTPGTPLTLTCTVSGFSLS

SEQ ID NO: 44 - protein, 5 aa, Oryctolagus cuniculus
SYAMS

SEQ ID NO: 45 - protein, 14 aa, Oryctolagus cuniculus
WVRQAPGKGLEWIG

SEQ ID NO: 46 - protein, 16 aa, Oryctolagus cuniculus
IIDAIDNTYYASWAKG

SEQ ID NO: 47 - protein, 30 aa, Oryctolagus cuniculus
RFTISKTSTTVDLKMTSLTTGDTATYFCAR

SEQ ID NO: 48 - protein, 14 aa, Oryctolagus cuniculus
ASILGYSIATGFNI

SEQ ID NO: 49 - protein, 11 aa, Artificial
  Humanized antibody sequence
WGPGTLVTVSS

SEQ ID NO: 50 - protein, 330 aa, Artificial; identical to SEQ ID NO: 10
  Humanized antibody sequence

SEQ ID NO: 51 - DNA, 1347 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccagggaaggggctggaatggatcggaatcattgatgctattgataacacatactacgcgagctgggcgaaaggccgattcaccatctccaaaacctcgaccacggtggatctgaaaatgaccagtctgacaaccggggacacggccacctatttctgtgccagagcctctattcttggttatagtattgctacgggctttaacatctggggcccagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - DNA, 357 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccagggaaggggctggaatggatcggaatcattgatgctattgataacacatactacgcgagctgggcgaaaggccgattcaccatctccaaaacctcgaccacggtggatctgaaaatgaccagtctgacaaccggggacacggccacctatttctgtgccagagcctctattcttggttatagtattgctacgggctttaacatctggggcccagggaccctcgtcaccgtctcgagc

SEQ ID NO: 53 - DNA, 87 bp, Oryctolagus cuniculus; identical to SEQ ID NO: 13

SEQ ID NO: 54 - DNA, 15 bp, Oryctolagus cuniculus
agctatgcaatgagc

SEQ ID NO: 55 - DNA, 42 bp, Oryctolagus cuniculus
tgggtccgccaggctccagggaaggggctggaatggatcgga

SEQ ID NO: 56 - DNA, 48 bp, Oryctolagus cuniculus
atcattgatgctattgataacacatactacgcgagctgggcgaaaggc

SEQ ID NO: 57 - DNA, 90 bp, Oryctolagus cuniculus
cgattcaccatctccaaaacctcgaccacggtggatctgaaaatgaccagtctgacaaccggggacacggccacctatttctgtgccaga

SEQ ID NO: 58 - DNA, 42 bp, Oryctolagus cuniculus
gcctctattcttggttatagtattgctacgggctttaacatc

SEQ ID NO: 59 - DNA, 33 bp, Artificial
  Humanized antibody sequence
tggggcccagggaccctcgtcaccgtctcgagc

SEQ ID NO: 60 - DNA, 990 bp, Artificial; identical to SEQ ID NO: 20
  Humanized antibody sequence

SEQ ID NO: 61 - protein, 217 aa, Artificial
  Humanized antibody sequence
AYDMTQTPASVEVAVGGTVTIKCQASQSISSHLAWYQQKSGQPPKLLIYRASTLESGVSSRFKGSGSGTEFTLTISDLECADAATYYCQQGYGVSDVDNGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 110 aa, Artificial
  Humanized antibody sequence
AYDMTQTPASVEVAVGGTVTIKCQASQSISSHLAWYQQKSGQPPKLLIYRASTLESGVSSRFKGSGSGTEFTLTISDLECADAATYYCQQGYGVSDVDNGFGGGTEVVVK

SEQ ID NO: 63 - protein, 23 aa, Oryctolagus cuniculus
AYDMTQTPASVEVAVGGTVTIKC

SEQ ID NO: 64 - protein, 11 aa, Oryctolagus cuniculus
QASQSISSHLA

SEQ ID NO: 65 - protein, 15 aa, Oryctolagus cuniculus
WYQQKSGQPPKLLIY

SEQ ID NO: 66 - protein, 7 aa, Oryctolagus cuniculus
RASTLES

SEQ ID NO: 67 - protein, 32 aa, Oryctolagus cuniculus
GVSSRFKGSGSGTEFTLTISDLECADAATYYC

SEQ ID NO: 68 - protein, 12 aa, Oryctolagus cuniculus
QQGYGVSDVDNG

SEQ ID NO: 69 - protein, 10 aa, Artificial
  Humanized antibody sequence
FGGGTEVVVK

SEQ ID NO: 70 - protein, 107 aa, Artificial [sequence omitted]

SEQ ID NO: 71 - DNA, 651 bp, Artificial
  Humanized antibody sequence
gcctatgatatgacccagactccagcctctgtggaggtagctgtgggaggcacagtcaccatcaagtgccaggccagtcagagcattagtagccacttagcctggtatcagcagaaatcagggcagcctcccaagctcctgatctacagggcatccactctggaatctggggtctcatcaaggttcaaaggcagtggatctgggacagagttcactctcaccatcagcgacctggagtgtgccgatgctgccacttactactgtcaacagggttatggtgttagtgatgttgataatggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 72 - DNA, 330 bp, Artificial
  Humanized antibody sequence
gcctatgatatgacccagactccagcctctgtggaggtagctgtgggaggcacagtcaccatcaagtgccaggccagtcagagcattagtagccacttagcctggtatcagcagaaatcagggcagcctcccaagctcctgatctacagggcatccactctggaatctggggtctcatcaaggttcaaaggcagtggatctgggacagagttcactctcaccatcagcgacctggagtgtgccgatgctgccacttactactgtcaacagggttatggtgttagtgatgttgataatggtttcggcggagggaccgaggtggtggtcaaa

SEQ ID NO: 73 - DNA, 69 bp, Oryctolagus cuniculus
gcctatgatatgacccagactccagcctctgtggaggtagctgtgggaggcacagtcaccatcaagtgc

SEQ ID NO: 74 - DNA, 33 bp, Oryctolagus cuniculus
caggccagtcagagcattagtagccacttagcc

SEQ ID NO: 75 - DNA, 45 bp, Oryctolagus cuniculus
tggtatcagcagaaatcagggcagcctcccaagctcctgatctac

SEQ ID NO: 76 - DNA, 21 bp, Oryctolagus cuniculus
agggcatccactctggaatct

SEQ ID NO: 77 - DNA, 96 bp, Oryctolagus cuniculus
ggggtctcatcaaggttcaaaggcagtggatctgggacagagttcactctcaccatcagcgacctggagtgtgccgatgctgccacttactactgt

SEQ ID NO: 78 - DNA, 36 bp, Oryctolagus cuniculus
caacagggttatggtgttagtgatgttgataatggt

SEQ ID NO: 79 - DNA, 30 bp, Artificial; identical to SEQ ID NO: 39
  Humanized antibody sequence

SEQ ID NO: 80 - DNA, 321 bp, Artificial; identical to SEQ ID NO: 40
  Humanized antibody sequence

SEQ ID NO: 81 - protein, 444 aa, Artificial
  Humanized antibody sequence
QSVEESGGRLVTPGGSLTLTCTASGFSLSSYYMSWVRQAPGKGLEWIGIIYPSGSTYYASWAKGRFTISKTSTTVDLKITSPTVEDTATYFCARGGAYATLNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 114 aa, Artificial
  Humanized antibody sequence
QSVEESGGRLVTPGGSLTLTCTASGFSLSSYYMSWVRQAPGKGLEWIGIIYPSGSTYYASWAKGRFTISKTSTTVDLKITSPTVEDTATYFCARGGAYATLNLWGPGTLVTVSS

SEQ ID NO: 83 - protein, 29 aa, Oryctolagus cuniculus
QSVEESGGRLVTPGGSLTLTCTASGFSLS

SEQ ID NO: 84 - protein, 5 aa, Oryctolagus cuniculus
SYYMS

SEQ ID NO: 85 - protein, 14 aa, Oryctolagus cuniculus
WVRQAPGKGLEWIG

SEQ ID NO: 86 - protein, 16 aa, Oryctolagus cuniculus
IIYPSGSTYYASWAKG

SEQ ID NO: 87 - protein, 30 aa, Oryctolagus cuniculus
RFTISKTSTTVDLKITSPTVEDTATYFCAR

SEQ ID NO: 88 - protein, 9 aa, Oryctolagus cuniculus
GGAYATLNL

SEQ ID NO: 89 - protein, 11 aa, Artificial
  Humanized antibody sequence
WGPGTLVTVSS

SEQ ID NO: 90 - protein, 330 aa, Artificial; identical to SEQ ID NO: 10
  Humanized antibody sequence

SEQ ID NO: 91 - DNA, 1332 bp, Artificial
  Humanized antibody sequence
cagtcggtggaggagtccgggggtcgcctggtcacgcctggaggatccctgacactcacctgcacagcctctggattctccctcagtagctactacatgagctgggtccgccaggctccagggaaggggctggaatggatcggaatcatttatcctagtggtagcacatactacgcgagctgggcgaaaggccgattcaccatctccaaaacctcgaccacggtggatctgaaaatcaccagtccgacagtcgaggacacggccacctatttctgtgccagaggaggtgcttatgctactcttaacttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - DNA, 342 bp, Artificial
  Humanized antibody sequence
cagtcggtggaggagtccgggggtcgcctggtcacgcctggaggatccctgacactcacctgcacagcctctggattctccctcagtagctactacatgagctgggtccgccaggctccagggaaggggctggaatggatcggaatcatttatcctagtggtagcacatactacgcgagctgggcgaaaggccgattcaccatctccaaaacctcgaccacggtggatctgaaaatcaccagtccgacagtcgaggacacggccacctatttctgtgccagaggaggtgcttatgctactcttaacttgtggggcccgggcaccctcgtcaccgtctcgagc

SEQ ID NO: 93 - DNA, 87 bp, Oryctolagus cuniculus
cagtcggtggaggagtccgggggtcgcctggtcacgcctggaggatccctgacactcacctgcacagcctctggattctccctcagt

SEQ ID NO: 94 - DNA, 15 bp, Oryctolagus cuniculus
agctactacatgagc

SEQ ID NO: 95 - DNA, 42 bp, Oryctolagus cuniculus; identical to SEQ ID NO: 55

SEQ ID NO: 96 - DNA, 48 bp, Oryctolagus cuniculus
atcatttatcctagtggtagcacatactacgcgagctgggcgaaaggc

SEQ ID NO: 97 - DNA, 90 bp, Oryctolagus cuniculus
cgattcaccatctccaaaacctcgaccacggtggatctgaaaatcaccagtccgacagtcgaggacacggccacctatttctgtgccaga

SEQ ID NO: 98 - DNA, 27 bp, Oryctolagus cuniculus
ggaggtgcttatgctactcttaacttg

SEQ ID NO: 99 - DNA, 33 bp, Artificial; identical to SEQ ID NO: 19
  Humanized antibody sequence

SEQ ID NO: 100 - DNA, 990 bp, Artificial; identical to SEQ ID NO: 20
  Humanized antibody sequence

SEQ ID NO: 101 - protein, 217 aa, Artificial
  Humanized antibody sequence
AVLTQTPSPVSAAVGGTVTISCQSSQSVYHNNLLSWYQQKPGQPPKLLIYDASKLTSGVSSRFSGSGSGTQFTLTISGVQCDDAATYYCLGGYDDDADNGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 110 aa, Artificial
  Humanized antibody sequence
AVLTQTPSPVSAAVGGTVTISCQSSQSVYHNNLLSWYQQKPGQPPKLLIYDASKLTSGVSSRFSGSGSGTQFTLTISGVQCDDAATYYCLGGYDDDADNGFGGGTEVVVK

SEQ ID NO: 103 - protein, 22 aa, Oryctolagus cuniculus
AVLTQTPSPVSAAVGGTVTISC

SEQ ID NO: 104 - protein, 13 aa, Oryctolagus cuniculus
QSSQSVYHNNLLS

SEQ ID NO: 105 - protein, 15 aa, Oryctolagus cuniculus
WYQQKPGQPPKLLIY

SEQ ID NO: 106 - protein, 7 aa, Oryctolagus cuniculus
DASKLTS

SEQ ID NO: 107 - protein, 32 aa, Oryctolagus cuniculus
GVSSRFSGSGSGTQFTLTISGVQCDDAATYYC

SEQ ID NO: 108 - protein, 11 aa, Oryctolagus cuniculus
LGGYDDDADNG

SEQ ID NO: 109 - protein, 10 aa, Artificial
  Humanized antibody sequence
FGGGTEVVVK

SEQ ID NO: 110 - protein, 107 aa, Artificial [sequence omitted]

SEQ ID NO: 111 - DNA, 651 bp, Artificial
  Humanized antibody sequence
gccgtgctgacccagacaccatcacccgtgtctgcagctgtgggaggcacagtcaccatcagttgccagtccagtcagagtgtttatcataacaacctcttatcctggtatcagcagaaaccaggtcagcctcccaagctcttgatctacgatgcatccaaactgacatctggggtctcatcgcggttcagcggcagtggatctgggacacagttcactctcaccataagcggcgtgcagtgtgacgatgctgccacttactactgtctaggcggttatgatgatgatgctgataatggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 112 - DNA, 330 bp, Artificial
  Humanized antibody sequence
gccgtgctgacccagacaccatcacccgtgtctgcagctgtgggaggcacagtcaccatcagttgccagtccagtcagagtgtttatcataacaacctcttatcctggtatcagcagaaaccaggtcagcctcccaagctcttgatctacgatgcatccaaactgacatctggggtctcatcgcggttcagcggcagtggatctgggacacagttcactctcaccataagcggcgtgcagtgtgacgatgctgccacttactactgtctaggcggttatgatgatgatgctgataatggtttcggcggagggaccgaggtggtggtcaaa

SEQ ID NO: 113 - DNA, 66 bp, Oryctolagus cuniculus
gccgtgctgacccagacaccatcacccgtgtctgcagctgtgggaggcacagtcaccatcagttgc

SEQ ID NO: 114 - DNA, 39 bp, Oryctolagus cuniculus
cagtccagtcagagtgtttatcataacaacctcttatcc

SEQ ID NO: 115 - DNA, 45 bp, Oryctolagus cuniculus
tggtatcagcagaaaccaggtcagcctcccaagctcttgatctac

SEQ ID NO: 116 - DNA, 21 bp, Oryctolagus cuniculus
gatgcatccaaactgacatct

SEQ ID NO: 117 - DNA, 96 bp, Oryctolagus cuniculus
ggggtctcatcgcggttcagcggcagtggatctgggacacagttcactctcaccataagcggcgtgcagtgtgacgatgctgccacttactactgt

SEQ ID NO: 118 - DNA, 33 bp, Oryctolagus cuniculus
ctaggcggttatgatgatgatgctgataatggt

SEQ ID NO: 119 - DNA, 30 bp, Artificial; identical to SEQ ID NO: 39
  Humanized antibody sequence

SEQ ID NO: 120 - DNA, 321 bp, Artificial; identical to SEQ ID NO: 40
  Humanized antibody sequence

SEQ ID NO: 121 - protein, 445 aa, Artificial
  Humanized antibody sequence
QSVEESGGRLVTPGTPLTLTCTVSGIDLSSYAMIWVRQAPEKGLEYIGYIGGIDSTYYASWAKGRFTISKTSTTVDLKMTSPTTEDTATYFCGRWSGTSGYNTIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 115 aa, Artificial
  Humanized antibody sequence
QSVEESGGRLVTPGTPLTLTCTVSGIDLSSYAMIWVRQAPEKGLEYIGYIGGIDSTYYASWAKGRFTISKTSTTVDLKMTSPTTEDTATYFCGRWSGTSGYNTIWGPGTLVTVSS

SEQ ID NO: 123 - protein, 29 aa, Oryctolagus cuniculus
QSVEESGGRLVTPGTPLTLTCTVSGIDLS

SEQ ID NO: 124 - protein, 5 aa, Oryctolagus cuniculus
SYAMI

SEQ ID NO: 125 - protein, 14 aa, Oryctolagus cuniculus
WVRQAPEKGLEYIG

SEQ ID NO: 126 - protein, 16 aa, Oryctolagus cuniculus
YIGGIDSTYYASWAKG

SEQ ID NO: 127 - protein, 30 aa, Oryctolagus cuniculus
RFTISKTSTTVDLKMTSPTTEDTATYFCGR

SEQ ID NO: 128 - protein, 10 aa, Oryctolagus cuniculus
WSGTSGYNTI

SEQ ID NO: 129 - protein, 11 aa, Artificial
  Humanized antibody sequence
WGPGTLVTVSS

SEQ ID NO: 130 - protein, 330 aa, Artificial; identical to SEQ ID NO: 10
  Humanized antibody sequence

SEQ ID NO: 131 - DNA, 1335 bp, Artificial
  Humanized antibody sequence
cagtcggtggaggagtccgggggtcgcctggtcacgcctgggacacccctgacactcacctgcacagtctctggaatcgacctcagtagctatgcaatgatctgggtccgtcaggctccagaaaaggggctggaatacatcggatatattggtggtattgatagcacatactacgcgagctgggcgaaaggccgattcaccatctccaaaacctcgaccacggtggatctgaaaatgaccagtccgacaaccgaggacacggccacctatttctgtggcagatggtccggtactagtggttataataccatctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 345 bp, Artificial
  Humanized antibody sequence
cagtcggtggaggagtccgggggtcgcctggtcacgcctgggacacccctgacactcacctgcacagtctctggaatcgacctcagtagctatgcaatgatctgggtccgtcaggctccagaaaaggggctggaatacatcggatatattggtggtattgatagcacatactacgcgagctgggcgaaaggccgattcaccatctccaaaacctcgaccacggtggatctgaaaatgaccagtccgacaaccgaggacacggccacctatttctgtggcagatggtccggtactagtggttataataccatctggggcccgggcaccctcgtcaccgtctcgagc

SEQ ID NO: 133 - DNA, 87 bp, Oryctolagus cuniculus
cagtcggtggaggagtccgggggtcgcctggtcacgcctgggacacccctgacactcacctgcacagtctctggaatcgacctcagt

SEQ ID NO: 134 - DNA, 15 bp, Oryctolagus cuniculus
agctatgcaatgatc

SEQ ID NO: 135 - DNA, 42 bp, Oryctolagus cuniculus
tgggtccgtcaggctccagaaaaggggctggaatacatcgga

SEQ ID NO: 136 - DNA, 48 bp, Oryctolagus cuniculus
tatattggtggtattgatagcacatactacgcgagctgggcgaaaggc

SEQ ID NO: 137 - DNA, 90 bp, Oryctolagus cuniculus
cgattcaccatctccaaaacctcgaccacggtggatctgaaaatgaccagtccgacaaccgaggacacggccacctatttctgtggcaga

SEQ ID NO: 138 - DNA, 30 bp, Oryctolagus cuniculus
tggtccggtactagtggttataataccatc

SEQ ID NO: 139 - DNA, 33 bp, Artificial; identical to SEQ ID NO: 19
  Humanized antibody sequence

SEQ ID NO: 140 - DNA, 990 bp, Artificial; identical to SEQ ID NO: 20
  Humanized antibody sequence

SEQ ID NO: 141 - protein, 216 aa, Artificial
  Humanized antibody sequence
DVVMTQTPASVEAAVGGTVTIKCQASQSIYSNLAWYQQKPGQPPKLLIYGASNLASGVSSRFKGSRSGTEYTLTISDLECADAATYYCQCTGGGDSGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 109 aa, Artificial
  Humanized antibody sequence
DVVMTQTPASVEAAVGGTVTIKCQASQSIYSNLAWYQQKPGQPPKLLIYGASNLASGVSSRFKGSRSGTEYTLTISDLECADAATYYCQCTGGGDSGNTFGGGTEVVVK

SEQ ID NO: 143 - protein, 23 aa, Oryctolagus cuniculus
DVVMTQTPASVEAAVGGTVTIKC

SEQ ID NO: 144 - protein, 11 aa, Oryctolagus cuniculus
QASQSIYSNLA

SEQ ID NO: 145 - protein, 15 aa, Oryctolagus cuniculus
WYQQKPGQPPKLLIY

SEQ ID NO: 146 - protein, 7 aa, Oryctolagus cuniculus
GASNLAS

SEQ ID NO: 147 - protein, 32 aa, Oryctolagus cuniculus
GVSSRFKGSRSGTEYTLTISDLECADAATYYC

SEQ ID NO: 148 - protein, 11 aa, Oryctolagus cuniculus
QCTGGGDSGNT

SEQ ID NO: 149 - protein, 10 aa, Artificial
  Humanized antibody sequence
FGGGTEVVVK

SEQ ID NO: 150 - protein, 107 aa, Artificial [sequence omitted]

SEQ ID NO: 151 - DNA, 648 bp, Artificial
  Humanized antibody sequence
gatgttgtgatgacccagactccagcctccgtggaggcagctgtgggaggcacagtcaccatcaagtgccaggccagtcagagcatttatagcaatttagcctggtatcagcagaaaccagggcagcctcccaagctcctgatctatggtgcatccaatctggcatctggggtctcatcgcggttcaaaggcagtcgatctgggacagagtacactctcaccatcagtgacctggagtgtgccgatgctgccacctactactgtcagtgcactggtggtggtgatagcggtaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 152 - DNA, 327 bp, Artificial
  Humanized antibody sequence
gatgttgtgatgacccagactccagcctccgtggaggcagctgtgggaggcacagtcaccatcaagtgccaggccagtcagagcatttatagcaatttagcctggtatcagcagaaaccagggcagcctcccaagctcctgatctatggtgcatccaatctggcatctggggtctcatcgcggttcaaaggcagtcgatctgggacagagtacactctcaccatcagtgacctggagtgtgccgatgctgccacctactactgtcagtgcactggtggtggtgatagcggtaatactttcggcggagggaccgaggtggtggtcaaa

SEQ ID NO: 153 - DNA, 69 bp, Oryctolagus cuniculus
gatgttgtgatgacccagactccagcctccgtggaggcagctgtgggaggcacagtcaccatcaagtgc

SEQ ID NO: 154 - DNA, 33 bp, Oryctolagus cuniculus
caggccagtcagagcatttatagcaatttagcc

SEQ ID NO: 155 - DNA, 45 bp, Oryctolagus cuniculus; identical to SEQ ID NO: 35

SEQ ID NO: 156 - DNA, 21 bp, Oryctolagus cuniculus
ggtgcatccaatctggcatct

SEQ ID NO: 157 - DNA, 96 bp, Oryctolagus cuniculus
ggggtctcatcgcggttcaaaggcagtcgatctgggacagagtacactctcaccatcagtgacctggagtgtgccgatgctgccacctactactgt

SEQ ID NO: 158 - DNA, 33 bp, Oryctolagus cuniculus
cagtgcactggtggtggtgatagcggtaatact

SEQ ID NO: 159 - DNA, 30 bp, Artificial; identical to SEQ ID NO: 39
  Humanized antibody sequence

SEQ ID NO: 160 - DNA, 321 bp, Artificial; identical to SEQ ID NO: 40
  Humanized antibody sequence

SEQ ID NO: 161 - protein, 446 aa, Artificial
  Humanized antibody sequence
QSVEESGGRLVTPGTPLTLTCTVSGFSLSSYAMSWVRQAPGKGLEWIGIISNSGTTYYASWAKGRFTISKTSTTVDLKITSPTTEDTATYFCARGIYWYWRVFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 116 aa, Artificial
  Humanized antibody sequence
QSVEESGGRLVTPGTPLTLTCTVSGFSLSSYAMSWVRQAPGKGLEWIGIISNSGTTYYASWAKGRFTISKTSTTVDLKITSPTTEDTATYFCARGIYWYWRVFNLWGPGTLVTVSS

SEQ ID NO: 163 - protein, 29 aa, Oryctolagus cuniculus
QSVEESGGRLVTPGTPLTLTCTVSGFSLS

SEQ ID NO: 164 - protein, 5 aa, Oryctolagus cuniculus
SYAMS

SEQ ID NO: 165 - protein, 14 aa, Oryctolagus cuniculus
WVRQAPGKGLEWIG

SEQ ID NO: 166 - protein, 16 aa, Oryctolagus cuniculus
IISNSGTTYYASWAKG

SEQ ID NO: 167 - protein, 30 aa, Oryctolagus cuniculus
RFTISKTSTTVDLKITSPTTEDTATYFCAR

SEQ ID NO: 168 - protein, 11 aa, Oryctolagus cuniculus
GIYWYWRVFNL

SEQ ID NO: 169 - protein, 11 aa, Artificial
  Humanized antibody sequence
WGPGTLVTVSS

SEQ ID NO: 170 - protein, 330 aa, Artificial; identical to SEQ ID NO: 10
  Humanized antibody sequence

SEQ ID NO: 171 - DNA, 1338 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccagggaaggggctggaatggatcggaatcattagtaatagtggtaccacatactacgcgagctgggcgaaaggccgattcaccatctccaaaacctcgaccacggtggatctgaaaatcaccagtccgacaaccgaggacacggccacctatttctgtgccagaggaatatattggtactggagagtttttaacttgtggggcccggggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - DNA, 348 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccagggaaggggctggaatggatcggaatcattagtaatagtggtaccacatactacgcgagctgggcgaaaggccgattcaccatctccaaaacctcgaccacggtggatctgaaaatcaccagtccgacaaccgaggacacggccacctatttctgtgccagaggaatatattggtactggagagtttttaacttgtggggcccggggaccctcgtcaccgtctcgagc

SEQ ID NO: 173 - DNA, 87 bp, Oryctolagus cuniculus; identical to SEQ ID NO: 13

SEQ ID NO: 174 - DNA, 15 bp, Oryctolagus cuniculus
agctatgcaatgagc

SEQ ID NO: 175 - DNA, 42 bp, Oryctolagus cuniculus; identical to SEQ ID NO: 55

SEQ ID NO: 176 - DNA, 48 bp, Oryctolagus cuniculus
atcattagtaatagtggtaccacatactacgcgagctgggcgaaaggc

SEQ ID NO: 177 - DNA, 90 bp, Oryctolagus cuniculus
cgattcaccatctccaaaacctcgaccacggtggatctgaaaatcaccagtccgacaaccgaggacacggccacctatttctgtgccaga

SEQ ID NO: 178 - DNA, 33 bp, Oryctolagus cuniculus
ggaatatattggtactggagagtttttaacttg

SEQ ID NO: 179 - DNA, 33 bp, Artificial
  Humanized antibody sequence
tggggcccggggaccctcgtcaccgtctcgagc

SEQ ID NO: 180 - DNA, 990 bp, Artificial; identical to SEQ ID NO: 20
  Humanized antibody sequence

SEQ ID NO: 181 - protein, 216 aa, Artificial
  Humanized antibody sequence
AVLTQTPSPVSAAVGGTVTINCQASQSVYNNLLSWYQQKPGQPPKLLIYDASNLASGVPDRFSGSGSGTQFTLTISGVQCDDAATYYCLGGYDDDADNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 109 aa, Artificial
  Humanized antibody sequence
AVLTQTPSPVSAAVGGTVTINCQASQSVYNNLLSWYQQKPGQPPKLLIYDASNLASGVPDRFSGSGSGTQFTLTISGVQCDDAATYYCLGGYDDDADNAFGGGTEVVVK

SEQ ID NO: 183 - protein, 22 aa, Oryctolagus cuniculus
AVLTQTPSPVSAAVGGTVTINC

SEQ ID NO: 184 - protein, 12 aa, Oryctolagus cuniculus
QASQSVYNNLLS

SEQ ID NO: 185 - protein, 15 aa, Oryctolagus cuniculus
WYQQKPGQPPKLLIY

SEQ ID NO: 186 - protein, 7 aa, Oryctolagus cuniculus
DASNLAS

SEQ ID NO: 187 - protein, 32 aa, Oryctolagus cuniculus
GVPDRFSGSGSGTQFTLTISGVQCDDAATYYC

SEQ ID NO: 188 - protein, 11 aa, Oryctolagus cuniculus
LGGYDDDADNA

SEQ ID NO: 189 - protein, 10 aa, Artificial
  Humanized antibody sequence
FGGGTEVVVK

SEQ ID NO: 190 - protein, 107 aa, Artificial [sequence omitted]

SEQ ID NO: 191 - DNA, 648 bp, Artificial
  Humanized antibody sequence
gccgtgctgacccagacaccatcgcctgtgtctgcagctgtgggaggcacagtcaccatcaattgccaggccagtcagagtgtttataacaacctcttatcctggtatcagcagaaaccagggcagcctcccaagctcctgatctatgatgcatccaatctggcatctggggtcccagataggttcagcggcagtggatctgggacacagttcactctcaccatcagcggcgtgcagtgtgacgatgctgccacttactactgtctaggcggttatgatgatgatgctgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - DNA, 327 bp, Artificial
  Humanized antibody sequence
gccgtgctgacccagacaccatcgcctgtgtctgcagctgtgggaggcacagtcaccatcaattgccaggccagtcagagtgtttataacaacctcttatcctggtatcagcagaaaccagggcagcctcccaagctcctgatctatgatgcatccaatctggcatctggggtcccagataggttcagcggcagtggatctgggacacagttcactctcaccatcagcggcgtgcagtgtgacgatgctgccacttactactgtctaggcggttatgatgatgatgctgataatgctttcggcggagggaccgaggtggtggtcaaa

SEQ ID NO: 193 - DNA, 66 bp, Oryctolagus cuniculus
gccgtgctgacccagacaccatcgcctgtgtctgcagctgtgggaggcacagtcaccatcaattgc

SEQ ID NO: 194 - DNA, 36 bp, Oryctolagus cuniculus
caggccagtcagagtgtttataacaacctcttatcc

SEQ ID NO: 195 - DNA, 45 bp, Oryctolagus cuniculus; identical to SEQ ID NO: 35

SEQ ID NO: 196 - DNA, 21 bp, Oryctolagus cuniculus
gatgcatccaatctggcatct

SEQ ID NO: 197 - DNA, 96 bp, Oryctolagus cuniculus
ggggtcccagataggttcagcggcagtggatctgggacacagttcactctcaccatcagcggcgtgcagtgtgacgatgctgccacttactactgt

SEQ ID NO: 198 - DNA, 33 bp, Oryctolagus cuniculus
ctaggcggttatgatgatgatgctgataatgct

SEQ ID NO: 199 - DNA, 30 bp, Artificial; identical to SEQ ID NO: 39
  Humanized antibody sequence

SEQ ID NO: 200 - DNA, 321 bp, Artificial; identical to SEQ ID NO: 40
  Humanized antibody sequence

SEQ ID NO: 201 - protein, 450 aa, Artificial
  Humanized antibody sequence
QEQLEESGGDLVKPEGSLTLTCTASGFSFSSNYWICWVRQAPGKGLEWIGCIRDGGGTYYASWAKGRLTISMTSSTTVTLQLNSLTAADTATYFCASDINDGWLGQFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 120 aa, Artificial
  Humanized antibody sequence
QEQLEESGGDLVKPEGSLTLTCTASGFSFSSNYWICWVRQAPGKGLEWIGCIRDGGGTYYASWAKGRLTISMTSSTTVTLQLNSLTAADTATYFCASDINDGWLGQFNLWGPGTLVTVSS

SEQ ID NO: 203 - protein, 30 aa, Oryctolagus cuniculus
QEQLEESGGDLVKPEGSLTLTCTASGFSFS

SEQ ID NO: 204 - protein, 6 aa, Oryctolagus cuniculus
SNYWIC

SEQ ID NO: 205 - protein, 14 aa, Oryctolagus cuniculus
WVRQAPGKGLEWIG

SEQ ID NO: 206 - protein, 16 aa, Oryctolagus cuniculus
CIRDGGGTYYASWAKG

SEQ ID NO: 207 - protein, 31 aa, Oryctolagus cuniculus
RLTISMTSSTTVTLQLNSLTAADTATYFCAS

SEQ ID NO: 208 - protein, 12 aa, Oryctolagus cuniculus
DINDGWLGQFNL

SEQ ID NO: 209 - protein, 11 aa, Artificial
  Humanized antibody sequence
WGPGTLVTVSS

SEQ ID NO: 210 - protein, 330 aa, Artificial; identical to SEQ ID NO: 10
  Humanized antibody sequence

SEQ ID NO: 211 - DNA, 1350 bp, Artificial
  Humanized antibody sequence
caggagcagctggaggagtccgggggagacctggtcaagcctgagggatccctgacactcacctgcacagcctctggattctccttcagtagcaactactggatatgctgggtccgccaggctccagggaagggactggagtggatcggatgcattcgtgatggtggtggcacttactacgcgagctgggcgaaaggccgactcaccatctccatgacctcgtcgaccacggtgactctgcaactgaacagtctgacagccgcggacacggccacctatttttgtgcgagcgatattaatgatgggtggcttggccaattcaacttgtggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 212 - DNA, 360 bp, Artificial
  Humanized antibody sequence
caggagcagctggaggagtccgggggagacctggtcaagcctgagggatccctgacactcacctgcacagcctctggattctccttcagtagcaactactggatatgctgggtccgccaggctccagggaagggactggagtggatcggatgcattcgtgatggtggtggcacttactacgcgagctgggcgaaaggccgactcaccatctccatgacctcgtcgaccacggtgactctgcaactgaacagtctgacagccgcggacacggccacctatttttgtgcgagcgatattaatgatgggtggcttggccaattcaacttgtggggcccaggcaccctcgtcaccgtctcgagc

SEQ ID NO: 213 - DNA, 90 bp, Oryctolagus cuniculus
caggagcagctggaggagtccgggggagacctggtcaagcctgagggatccctgacactcacctgcacagcctctggattctccttcagt

SEQ ID NO: 214 - DNA, 18 bp, Oryctolagus cuniculus
agcaactactggatatgc

SEQ ID NO: 215 - DNA, 42 bp, Oryctolagus cuniculus
tgggtccgccaggctccagggaagggactggagtggatcgga

SEQ ID NO: 216 - DNA, 48 bp, Oryctolagus cuniculus
tgcattcgtgatggtggtggcacttactacgcgagctgggcgaaaggc

SEQ ID NO: 217 - DNA, 93 bp, Oryctolagus cuniculus
cgactcaccatctccatgacctcgtcgaccacggtgactctgcaactgaacagtctgacagccgcggacacggccacctatttttgtgcgagc

SEQ ID NO: 218 - DNA, 36 bp, Oryctolagus cuniculus
gatattaatgatgggtggcttggccaattcaacttg

SEQ ID NO: 219 - DNA, 33 bp, Artificial
  Humanized antibody sequence
tggggcccaggcaccctcgtcaccgtctcgagc

SEQ ID NO: 220 - DNA, 990 bp, Artificial; identical to SEQ ID NO: 20
  Humanized antibody sequence

SEQ ID NO: 221 - protein, 220 aa, Artificial
  Humanized antibody sequence
ADIVMTQTPASVEVAVGGTVTIKCQASQSISAYLAWYQQKPGQPPKLLIYRAYTLASGVPSRFKGSGSGTQFTLTISDLECADAATYYCQSYYSVTTNTYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 113 aa, Artificial
  Humanized antibody sequence
ADIVMTQTPASVEVAVGGTVTIKCQASQSISAYLAWYQQKPGQPPKLLIYRAYTLASGVPSRFKGSGSGTQFTLTISDLECADAATYYCQSYYSVTTNTYGNTFGGGTEVVVK

SEQ ID NO: 223 - protein, 24 aa, Oryctolagus cuniculus
ADIVMTQTPASVEVAVGGTVTIKC

SEQ ID NO: 224 - protein, 11 aa, Oryctolagus cuniculus
QASQSISAYLA

SEQ ID NO: 225 - protein, 15 aa, Oryctolagus cuniculus
WYQQKPGQPPKLLIY

SEQ ID NO: 226 - protein, 7 aa, Oryctolagus cuniculus
RAYTLAS

SEQ ID NO: 227 - protein, 32 aa, Oryctolagus cuniculus
GVPSRFKGSGSGTQFTLTISDLECADAATYYC

SEQ ID NO: 228 - protein, 14 aa, Oryctolagus cuniculus
QSYYSVTTNTYGNT

SEQ ID NO: 229 - protein, 10 aa, Artificial
  Humanized antibody sequence
FGGGTEVVVK

SEQ ID NO: 230 - protein, 107 aa, Artificial [sequence omitted]

SEQ ID NO: 231 - DNA, 660 bp, Artificial
  Humanized antibody sequence
gctgacattgtgatgacccagactccagcctctgtggaggtagctgtgggaggcacagtcaccatcaagtgccaggccagtcagagcattagtgcgtacttagcctggtatcagcagaaaccagggcagcctcccaagctcctgatctacagggcatacactctggcatctggggtcccatcgcggttcaaaggcagtggatctgggacacagttcactctcaccatcagcgacctggagtgtgccgatgctgccacttactactgtcaaagctattattccgttactactaatacttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 339 bp, Artificial
  Humanized antibody sequence
gctgacattgtgatgacccagactccagcctctgtggaggtagctgtgggaggcacagtcaccatcaagtgccaggccagtcagagcattagtgcgtacttagcctggtatcagcagaaaccagggcagcctcccaagctcctgatctacagggcatacactctggcatctggggtcccatcgcggttcaaaggcagtggatctgggacacagttcactctcaccatcagcgacctggagtgtgccgatgctgccacttactactgtcaaagctattattccgttactactaatacttatggaaatactttcggcggagggaccgaggtggtggtcaaa

SEQ ID NO: 233 - DNA, 72 bp, Oryctolagus cuniculus
gctgacattgtgatgacccagactccagcctctgtggaggtagctgtgggaggcacagtcaccatcaagtgc

SEQ ID NO: 234 - DNA, 33 bp, Oryctolagus cuniculus
caggccagtcagagcattagtgcgtacttagcc

SEQ ID NO: 235 - DNA, 45 bp, Oryctolagus cuniculus
tggtatcagcagaaaccagggcagcctcccaagctcctgatctac

SEQ ID NO: 236 - DNA, 21 bp, Oryctolagus cuniculus
agggcatacactctggcatct

SEQ ID NO: 237 - DNA, 96 bp, Oryctolagus cuniculus
ggggtcccatcgcggttcaaaggcagtggatctgggacacagttcactctcaccatcagcgacctggagtgtgccgatgctgccacttactactgt

SEQ ID NO: 238 - DNA, 42 bp, Oryctolagus cuniculus
caaagctattattccgttactactaatacttatggaaatact

SEQ ID NO: 239 - DNA, 30 bp, Artificial; identical to SEQ ID NO: 39
  Humanized antibody sequence

SEQ ID NO: 240 - DNA, 321 bp, Artificial; identical to SEQ ID NO: 40
  Humanized antibody sequence

SEQ ID NO: 241 - protein, 451 aa, Artificial
  Humanized antibody sequence
EVQLVESGGGLVQPGGSLRLSCAASGFTVSSNYWICWVRQAPGKGLEWIGCIRDGGGTYYASSAKGRFTISRDNSKNTLYLQMNSLRAEDTAVYYCASDINDGWLGQFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 121 aa, Artificial
  Humanized antibody sequence
EVQLVESGGGLVQPGGSLRLSCAASGFTVSSNYWICWVRQAPGKGLEWIGCIRDGGGTYYASSAKGRFTISRDNSKNTLYLQMNSLRAEDTAVYYCASDINDGWLGQFNLWGQGTLVTVSS

SEQ ID NO: 243 - protein, 30 aa, Artificial
  Humanized antibody sequence
EVQLVESGGGLVQPGGSLRLSCAASGFTVS

SEQ ID NO: 244 - protein, 6 aa, Oryctolagus cuniculus
SNYWIC

SEQ ID NO: 245 - protein, 14 aa, Artificial
  Humanized antibody sequence
WVRQAPGKGLEWIG

SEQ ID NO: 246 - protein, 16 aa, Artificial
  Humanized antibody sequence
CIRDGGGTYYASSAKG

SEQ ID NO: 247 - protein, 32 aa, Artificial
  Humanized antibody sequence
RFTISRDNSKNTLYLQMNSLRAEDTAVYYCAS

SEQ ID NO: 248 - protein, 12 aa, Oryctolagus cuniculus
DINDGWLGQFNL

SEQ ID NO: 249 - protein, 11 aa, Artificial
  Humanized antibody sequence
WGQGTLVTVSS

SEQ ID NO: 250 - protein, 330 aa, Artificial; identical to SEQ ID NO: 10
  Humanized antibody sequence

SEQ ID NO: 251 - DNA, 1353 bp, Artificial
  Humanized antibody sequence
gaggtgcagcttgtggagtctgggggaggcttggtccagcctggggggtccctgagactctcctgtgcagcctctggattcaccgtcagtagcaactactggatatgctgggtccgtcaggctccagggaaggggctggagtggatcggatgcattcgtgatggtggtggcacttactacgctagctctgctaaaggccgattcaccatctccagagacaattccaagaacaccctgtatcttcaaatgaacagcctgagagctgaggacactgctgtgtattactgtgctagcgatatcaatgatgggtggcttggccaattcaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 252 - DNA, 363 bp, Artificial
  Humanized antibody sequence
gaggtgcagcttgtggagtctgggggaggcttggtccagcctggggggtccctgagactctcctgtgcagcctctggattcaccgtcagtagcaactactggatatgctgggtccgtcaggctccagggaaggggctggagtggatcggatgcattcgtgatggtggtggcacttactacgctagctctgctaaaggccgattcaccatctccagagacaattccaagaacaccctgtatcttcaaatgaacagcctgagagctgaggacactgctgtgtattactgtgctagcgatatcaatgatgggtggcttggccaattcaacttgtggggccaagggaccctcgtcaccgtctcgagc

SEQ ID NO: 253 - DNA, 90 bp, Artificial
  Humanized antibody sequence
gaggtgcagcttgtggagtctgggggaggcttggtccagcctggggggtccctgagactctcctgtgcagcctctggattcaccgtcagt

SEQ ID NO: 254 - DNA, 18 bp, Oryctolagus cuniculus
agcaactactggatatgc

SEQ ID NO: 255 - DNA, 42 bp, Artificial
  Humanized antibody sequence
tgggtccgtcaggctccagggaaggggctggagtggatcgga

SEQ ID NO: 256 - DNA, 48 bp, Artificial
  Humanized antibody sequence
tgcattcgtgatggtggtggcacttactacgctagctctgctaaaggc

SEQ ID NO: 257 - DNA, 96 bp, Artificial
  Humanized antibody sequence
cgattcaccatctccagagacaattccaagaacaccctgtatcttcaaatgaacagcctgagagctgaggacactgctgtgtattactgtgctagc

SEQ ID NO: 258 - DNA, 36 bp, Artificial
  Humanized antibody sequence
gatatcaatgatgggtggcttggccaattcaacttg

SEQ ID NO: 259 - DNA, 33 bp, Artificial
  Humanized antibody sequence
tggggccaagggaccctcgtcaccgtctcgagc

SEQ ID NO: 260 - DNA, 990 bp, Artificial; identical to SEQ ID NO: 20
  Humanized antibody sequence

SEQ ID NO: 261 - protein, 220 aa, Artificial
  Humanized antibody sequence
ADIVMTQSPSSLSASVGDRVTIKCQASQSISAYLAWYQQKPGKVPKLLIYRAYTLASGVPSRFSGSGSGTDFTLTISSLQPEDVATYYCQSYYSVTTNTYGNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 113 aa, Artificial
  Humanized antibody sequence
ADIVMTQSPSSLSASVGDRVTIKCQASQSISAYLAWYQQKPGKVPKLLIYRAYTLASGVPSRFSGSGSGTDFTLTISSLQPEDVATYYCQSYYSVTTNTYGNTFGGGTKVEIK

SEQ ID NO: 263 - protein, 24 aa, Artificial
  Humanized antibody sequence
ADIVMTQSPSSLSASVGDRVTIKC

SEQ ID NO: 264 - protein, 11 aa, Oryctolagus cuniculus
QASQSISAYLA

SEQ ID NO: 265 - protein, 15 aa, Artificial
  Humanized antibody sequence
WYQQKPGKVPKLLIY

SEQ ID NO: 266 - protein, 7 aa, Oryctolagus cuniculus
RAYTLAS

SEQ ID NO: 267 - protein, 32 aa, Artificial
  Humanized antibody sequence
GVPSRFSGSGSGTDFTLTISSLQPEDVATYYC

SEQ ID NO: 268 - protein, 14 aa, Oryctolagus cuniculus
QSYYSVTTNTYGNT

SEQ ID NO: 269 - protein, 10 aa, Artificial
  Humanized antibody sequence
FGGGTKVEIK

SEQ ID NO: 270 - protein, 107 aa, Artificial [sequence omitted]

SEQ ID NO: 271 - DNA, 660 bp, Artificial
  Humanized antibody sequence
gctgacattgtgatgacccagtctccatcctccctgtctgcatctgtaggagacagagtcaccatcaagtgccaggccagtcagagcattagtgcttacttagcctggtatcagcagaaaccagggaaagtccctaagctcctgatctatagggcatacactctggcatctggggtcccatctcgtttcagtggcagtggatctgggacagatttcactctcaccatcagcagcctgcagcctgaagatgttgcaacttattactgtcaaagctactattccgttactactaatacttatggaaatactttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 272 - DNA, 339 bp, Artificial
  Humanized antibody sequence
gctgacattgtgatgacccagtctccatcctccctgtctgcatctgtaggagacagagtcaccatcaagtgccaggccagtcagagcattagtgcttacttagcctggtatcagcagaaaccagggaaagtccctaagctcctgatctatagggcatacactctggcatctggggtcccatctcgtttcagtggcagtggatctgggacagatttcactctcaccatcagcagcctgcagcctgaagatgttgcaacttattactgtcaaagctactattccgttactactaatacttatggaaatactttcggcggaggaaccaaggtggaaatcaaa

SEQ ID NO: 273 - DNA, 72 bp, Artificial
  Humanized antibody sequence
gctgacattgtgatgacccagtctccatcctccctgtctgcatctgtaggagacagagtcaccatcaagtgc

SEQ ID NO: 274 - DNA, 33 bp, Artificial
  Humanized antibody sequence
caggccagtcagagcattagtgcttacttagcc

SEQ ID NO: 275 - DNA, 45 bp, Artificial
  Humanized antibody sequence
tggtatcagcagaaaccagggaaagtccctaagctcctgatctat

SEQ ID NO: 276 - DNA, 21 bp, Oryctolagus cuniculus
agggcatacactctggcatct

SEQ ID NO: 277 - DNA, 96 bp, Artificial
  Humanized antibody sequence
ggggtcccatctcgtttcagtggcagtggatctgggacagatttcactctcaccatcagcagcctgcagcctgaagatgttgcaacttattactgt

SEQ ID NO: 278 - DNA, 42 bp, Artificial
  Humanized antibody sequence
caaagctactattccgttactactaatacttatggaaatact

SEQ ID NO: 279 - DNA, 30 bp, Artificial
  Humanized antibody sequence
ttcggcggaggaaccaaggtggaaatcaaa

SEQ ID NO: 280 - DNA, 321 bp, Artificial
  Humanized antibody sequence
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 281 - protein, 456 aa, Artificial [sequence omitted]

SEQ ID NO: 282 - protein, 126 aa, Artificial
  Humanized antibody sequence
QEQLVESGGGLVQPEGSLTLTCTASGFSFTSDYYMCWVRQAPGKGLEWIGCISTGDGSTYYASWAKGRFTISKPSSTTVTLQMTRLTAADTATYFCARDRYYSYAYGAYVYASDLWGPGTLVTVSS

SEQ ID NO: 283 - protein, 30 aa, Oryctolagus cuniculus
QEQLVESGGGLVQPEGSLTLTCTASGFSFT

SEQ ID NO: 284 - protein, 6 aa, Oryctolagus cuniculus
SDYYMC

SEQ ID NO: 285 - protein, 14 aa, Oryctolagus cuniculus
WVRQAPGKGLEWIG

SEQ ID NO: 286 - protein, 17 aa, Oryctolagus cuniculus
CISTGDGSTYYASWAKG

SEQ ID NO: 287 - protein, 31 aa, Oryctolagus cuniculus
RFTISKPSSTTVTLQMTRLTAADTATYFCAR

SEQ ID NO: 288 - protein, 17 aa, Oryctolagus cuniculus
DRYYSYAYGAYVYASDL

SEQ ID NO: 289 - protein, 11 aa, Artificial
  Humanized antibody sequence
WGPGTLVTVSS

SEQ ID NO: 290 - protein, 330 aa, Artificial; identical to SEQ ID NO: 10
  Humanized antibody sequence

SEQ ID NO: 291 - DNA, 1368 bp, Artificial
  Humanized antibody sequence
caggagcagctggtggagtccgggggaggcctggtccagcctgagggatccctgacactcacctgcacagcttctggattctccttcactagcgactattacatgtgctgggtccgccaggctccagggaaggggctggagtggatcggatgcatttctactggtgatggcagcacatactacgcgagctgggcgaaaggccgattcaccatctccaaaccctcgtcgaccacggtgactctgcaaatgaccaggctgacagccgcggacacggccacctatttctgtgcgagagatcgatactatagttatgcttatggtgcttatgtttatgctagcgacttgtggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 292 - DNA, 378 bp, Artificial
  Humanized antibody sequence
caggagcagctggtggagtccgggggaggcctggtccagcctgagggatccctgacactcacctgcacagcttctggattctccttcactagcgactattacatgtgctgggtccgccaggctccagggaaggggctggagtggatcggatgcatttctactggtgatggcagcacatactacgcgagctgggcgaaaggccgattcaccatctccaaaccctcgtcgaccacggtgactctgcaaatgaccaggctgacagccgcggacacggccacctatttctgtgcgagagatcgatactatagttatgcttatggtgcttatgtttatgctagcgacttgtggggcccaggcaccctcgtcaccgtctcgagc

SEQ ID NO: 293 - DNA, 90 bp, Oryctolagus cuniculus
caggagcagctggtggagtccgggggaggcctggtccagcctgagggatccctgacactcacctgcacagcttctggattctccttcact

SEQ ID NO: 294 - DNA, 18 bp, Oryctolagus cuniculus
agcgactattacatgtgc

SEQ ID NO: 295 - DNA, 42 bp, Oryctolagus cuniculus
tgggtccgccaggctccagggaaggggctggagtggatcgga

SEQ ID NO: 296 - DNA, 51 bp, Oryctolagus cuniculus
tgcatttctactggtgatggcagcacatactacgcgagctgggcgaaaggc

SEQ ID NO: 297 - DNA, 93 bp, Oryctolagus cuniculus
cgattcaccatctccaaaccctcgtcgaccacggtgactctgcaaatgaccaggctgacagccgcggacacggccacctatttctgtgcgaga

SEQ ID NO: 298 - DNA, 51 bp, Oryctolagus cuniculus
gatcgatactatagttatgcttatggtgcttatgtttatgctagcgacttg

SEQ ID NO: 299 - DNA, 33 bp, Artificial; identical to SEQ ID NO: 219
  Humanized antibody sequence

SEQ ID NO: 300 - DNA, 990 bp, Artificial; identical to SEQ ID NO: 20
  Humanized antibody sequence

SEQ ID NO: 301 - protein, 220 aa, Artificial
  Humanized antibody sequence
ADIVMTQTPASVSEPVGGTVTINCQASESIRNYLSWYQQKPGQRPKLLIYGASTLASGVPSRFKGSGSGTDFTLTISDLECADAATYYCQSNYGISSRSYVNGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 113 aa, Artificial
  Humanized antibody sequence
ADIVMTQTPASVSEPVGGTVTINCQASESIRNYLSWYQQKPGQRPKLLIYGASTLASGVPSRFKGSGSGTDFTLTISDLECADAATYYCQSNYGISSRSYVNGFGGGTEVVVK

SEQ ID NO: 303 - protein, 24 aa, Oryctolagus cuniculus
ADIVMTQTPASVSEPVGGTVTINC

SEQ ID NO: 304 - protein, 11 aa, Oryctolagus cuniculus
QASESIRNYLS

SEQ ID NO: 305 - protein, 15 aa, Oryctolagus cuniculus
WYQQKPGQRPKLLIY

SEQ ID NO: 306 - protein, 7 aa, Oryctolagus cuniculus
GASTLAS

SEQ ID NO: 307 - protein, 32 aa, Oryctolagus cuniculus
GVPSRFKGSGSGTDFTLTISDLECADAATYYC

SEQ ID NO: 308 - protein, 14 aa, Oryctolagus cuniculus
QSNYGISSRSYVNG

SEQ ID NO: 309 - protein, 10 aa, Artificial
  Humanized antibody sequence
FGGGTEVVVK

SEQ ID NO: 310 - protein, 107 aa, Artificial [sequence omitted]

SEQ ID NO: 311 - DNA, 660 bp, Artificial
  Humanized antibody sequence
gctgacattgtgatgacccagactccagcctccgtgtctgaacctgtgggaggcacagtcaccatcaattgccaggccagtgaaagcattaggaactacttatcctggtatcaacagaaaccagggcagcgtcccaagctcctgatctatggtgcatccactctggcatctggggtcccatcgcggttcaaaggcagtggatctgggacagatttcactctcaccatcagcgacctggagtgtgccgatgctgccacttactactgtcaaagcaattatggtattagtagtcgtagttatgttaatggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 312 - DNA, 339 bp, Artificial
  Humanized antibody sequence
gctgacattgtgatgacccagactccagcctccgtgtctgaacctgtgggaggcacagtcaccatcaattgccaggccagtgaaagcattaggaactacttatcctggtatcaacagaaaccagggcagcgtcccaagctcctgatctatggtgcatccactctggcatctggggtcccatcgcggttcaaaggcagtggatctgggacagatttcactctcaccatcagcgacctggagtgtgccgatgctgccacttactactgtcaaagcaattatggtattagtagtcgtagttatgttaatggtttcggcggagggaccgaggtggtggtcaaa

SEQ ID NO: 313 - DNA, 72 bp, Oryctolagus cuniculus
gctgacattgtgatgacccagactccagcctccgtgtctgaacctgtgggaggcacagtcaccatcaattgc

SEQ ID NO: 314 - DNA, 33 bp, Oryctolagus cuniculus
caggccagtgaaagcattaggaactacttatcc

SEQ ID NO: 315 - DNA, 45 bp, Oryctolagus cuniculus
tggtatcaacagaaaccagggcagcgtcccaagctcctgatctat

SEQ ID NO: 316 - DNA, 21 bp, Oryctolagus cuniculus
ggtgcatccactctggcatct

SEQ ID NO: 317 - DNA, 96 bp, Oryctolagus cuniculus
ggggtcccatcgcggttcaaaggcagtggatctgggacagatttcactctcaccatcagcgacctggagtgtgccgatgctgccacttactactgt

SEQ ID NO: 318 - DNA, 42 bp, Oryctolagus cuniculus
caaagcaattatggtattagtagtcgtagttatgttaatggt

SEQ ID NO: 319 - DNA, 30 bp, Artificial; identical to SEQ ID NO: 39
  Humanized antibody sequence

SEQ ID NO: 320 - DNA, 321 bp, Artificial; identical to SEQ ID NO: 40
  Humanized antibody sequence

SEQ ID NO: 321 - protein, 450 aa, Artificial
  Humanized antibody sequence
QSVEESGGRLVTPGTPLTLTCTVSGIDLSSYAMGWVRQAPGKGLEYIGIIVSYGPTYYASWAKGRFTISKTSTTVDLKITSPTAEDTATYFCARDLDANSSGYYGCFNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 120 aa, Artificial
  Humanized antibody sequence
QSVEESGGRLVTPGTPLTLTCTVSGIDLSSYAMGWVRQAPGKGLEYIGIIVSYGPTYYASWAKGRFTISKTSTTVDLKITSPTAEDTATYFCARDLDANSSGYYGCFNIWGQGTLVTVSS

SEQ ID NO: 323 - protein, 29 aa, Oryctolagus cuniculus
QSVEESGGRLVTPGTPLTLTCTVSGIDLS

SEQ ID NO: 324 - protein, 5 aa, Oryctolagus cuniculus
SYAMG

SEQ ID NO: 325 - protein, 14 aa, Oryctolagus cuniculus
WVRQAPGKGLEYIG

SEQ ID NO: 326 - protein, 16 aa, Oryctolagus cuniculus
IIVSYGPTYYASWAKG

SEQ ID NO: 327 - protein, 30 aa, Oryctolagus cuniculus
RFTISKTSTTVDLKITSPTAEDTATYFCAR

SEQ ID NO: 328 - protein, 15 aa, Oryctolagus cuniculus
DLDANSSGYYGCFNI

SEQ ID NO: 329 - protein, 11 aa, Artificial
  Humanized antibody sequence
WGQGTLVTVSS

SEQ ID NO: 330 - protein, 330 aa, Artificial; identical to SEQ ID NO: 10
  Humanized antibody sequence

SEQ ID NO: 331 - DNA, 1350 bp, Artificial
  Humanized antibody sequence
cagtcggtggaggagtccgggggtcgcctggtaacgcctgggacacccctgacactcacctgcacagtctctggaatcgacctcagtagctatgcaatgggctgggtccgccaggctccagggaaggggctggaatacatcggaatcattgttagttatgggcccacatactacgcgagctgggcgaaaggccgattcaccatctccaaaacctcgaccacggtggatctgaaaatcaccagtccgacggccgaggacacggccacctatttctgtgccagagatctggatgctaatagtagtggttattatggatgctttaacatctggggccaggggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 360 bp, Artificial
  Humanized antibody sequence
cagtcggtggaggagtccgggggtcgcctggtaacgcctgggacacccctgacactcacctgcacagtctctggaatcgacctcagtagctatgcaatgggctgggtccgccaggctccagggaaggggctggaatacatcggaatcattgttagttatgggcccacatactacgcgagctgggcgaaaggccgattcaccatctccaaaacctcgaccacggtggatctgaaaatcaccagtccgacggccgaggacacggccacctatttctgtgccagagatctggatgctaatagtagtggttattatggatgctttaacatctggggccaggggaccctcgtcaccgtctcgagc

SEQ ID NO: 333 - DNA, 87 bp, Oryctolagus cuniculus
cagtcggtggaggagtccgggggtcgcctggtaacgcctgggacacccctgacactcacctgcacagtctctggaatcgacctcagt

SEQ ID NO: 334 - DNA, 15 bp, Oryctolagus cuniculus
agctatgcaatgggc

SEQ ID NO: 335 - DNA, 42 bp, Oryctolagus cuniculus; identical to SEQ ID NO: 15

SEQ ID NO: 336 - DNA, 48 bp, Oryctolagus cuniculus
atcattgttagttatgggcccacatactacgcgagctgggcgaaaggc

SEQ ID NO: 337 - DNA, 90 bp, Oryctolagus cuniculus
cgattcaccatctccaaaacctcgaccacggtggatctgaaaatcaccagtccgacggccgaggacacggccacctatttctgtgccaga

SEQ ID NO: 338 - DNA, 45 bp, Oryctolagus cuniculus
gatctggatgctaatagtagtggttattatggatgctttaacatc

SEQ ID NO: 339 - DNA, 33 bp, Artificial
  Humanized antibody sequence
tggggccaggggaccctcgtcaccgtctcgagc

SEQ ID NO: 340 - DNA, 990 bp, Artificial; identical to SEQ ID NO: 20
  Humanized antibody sequence

SEQ ID NO: 341 - protein, 215 aa, Artificial
  Humanized antibody sequence
AVVLTQTPASVSAAVGGTVTIKCQASQSISTALAWYQQKPGQPPKLLIYAASPLASGVSSRFKSSGSGTEFTLTISDLECADAATYYCQSYYGSSNIAFGGGTELEILRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 108 aa, Artificial
  Humanized antibody sequence
AVVLTQTPASVSAAVGGTVTIKCQASQSISTALAWYQQKPGQPPKLLIYAASPLASGVSSRFKSSGSGTEFTLTISDLECADAATYYCQSYYGSSNIAFGGGTELEIL

SEQ ID NO: 343 - protein, 23 aa, Oryctolagus cuniculus
AVVLTQTPASVSAAVGGTVTIKC

SEQ ID NO: 344 - protein, 11 aa, Oryctolagus cuniculus
QASQSISTALA

SEQ ID NO: 345 - protein, 15 aa, Oryctolagus cuniculus
WYQQKPGQPPKLLIY

SEQ ID NO: 346 - protein, 7 aa, Oryctolagus cuniculus
AASPLAS

SEQ ID NO: 347 - protein, 32 aa, Oryctolagus cuniculus
GVSSRFKSSGSGTEFTLTISDLECADAATYYC

SEQ ID NO: 348 - protein, 10 aa, Oryctolagus cuniculus
QSYYGSSNIA

SEQ ID NO: 349 - protein, 10 aa, Artificial
  Humanized antibody sequence
FGGGTELEIL

SEQ ID NO: 350 - protein, 107 aa, Artificial [sequence omitted]

SEQ ID NO: 351 - DNA, 645 bp, Artificial
  Humanized antibody sequence
gccgtcgtgctgacccagactccagcctccgtgtctgcagctgtgggtggcacagtcaccatcaagtgccaggccagtcagagcattagcactgcattagcctggtatcagcagaaaccagggcagcctcccaagctcctgatctatgctgcatcccctctggcatctggggtctcatcgcggttcaagagcagtggatctgggacagagttcactctcaccatcagcgacctggagtgtgccgatgctgccacttattactgtcaaagctattatggtagtagcaatattgctttcggcggagggaccgagctggagatcctacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 352 - DNA, 324 bp, Artificial
  Humanized antibody sequence
gccgtcgtgctgacccagactccagcctccgtgtctgcagctgtgggtggcacagtcaccatcaagtgccaggccagtcagagcattagcactgcattagcctggtatcagcagaaaccagggcagcctcccaagctcctgatctatgctgcatcccctctggcatctggggtctcatcgcggttcaagagcagtggatctgggacagagttcactctcaccatcagcgacctggagtgtgccgatgctgccacttattactgtcaaagctattatggtagtagcaatattgctttcggcggagggaccgagctggagatccta

SEQ ID NO: 353 - DNA, 69 bp, Oryctolagus cuniculus
gccgtcgtgctgacccagactccagcctccgtgtctgcagctgtgggtggcacagtcaccatcaagtgc

SEQ ID NO: 354 - DNA, 33 bp, Oryctolagus cuniculus
caggccagtcagagcattagcactgcattagcc

SEQ ID NO: 355 - DNA, 45 bp, Oryctolagus cuniculus; identical to SEQ ID NO: 35

SEQ ID NO: 356 - DNA, 21 bp, Oryctolagus cuniculus
gctgcatcccctctggcatct

SEQ ID NO: 357 - DNA, 96 bp, Oryctolagus cuniculus
ggggtctcatcgcggttcaagagcagtggatctgggacagagttcactctcaccatcagcgacctggagtgtgccgatgctgccacttattactgt

SEQ ID NO: 358 - DNA, 30 bp, Oryctolagus cuniculus
caaagctattatggtagtagcaatattgct

SEQ ID NO: 359 - DNA, 30 bp, Artificial
  Humanized antibody sequence
ttcggcggagggaccgagctggagatccta

SEQ ID NO: 360 - DNA, 321 bp, Artificial; identical to SEQ ID NO: 40
  Humanized antibody sequence

SEQ ID NO: 361 - protein, 450 aa, Artificial
  Humanized antibody sequence
QEQLEESGGDLVKPEGSLTLTCTASGFSFSSSYWICWVRQAPGKGLEWIACIRAGGGNYYANWAKGRFTISRTSSTTVTLQMTSLTAADTATYFCASDINDGWLGQFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 120 aa, Artificial
  Humanized antibody sequence
QEQLEESGGDLVKPEGSLTLTCTASGFSFSSSYWICWVRQAPGKGLEWIACIRAGGGNYYANWAKGRFTISRTSSTTVTLQMTSLTAADTATYFCASDINDGWLGQFNLWGPGTLVTVSS

SEQ ID NO: 363 - protein, 30 aa, Oryctolagus cuniculus; identical to SEQ ID NO: 203

SEQ ID NO: 364 - protein, 6 aa, Oryctolagus cuniculus
SSYWIC

SEQ ID NO: 365 - protein, 14 aa, Oryctolagus cuniculus
WVRQAPGKGLEWIA

SEQ ID NO: 366 - protein, 16 aa, Oryctolagus cuniculus
CIRAGGGNYYANWAKG

SEQ ID NO: 367 - protein, 31 aa, Oryctolagus cuniculus
RFTISRTSSTTVTLQMTSLTAADTATYFCAS

SEQ ID NO: 368 - protein, 12 aa, Oryctolagus cuniculus
DINDGWLGQFNL

SEQ ID NO: 369 - protein, 11 aa, Artificial
  Humanized antibody sequence
WGPGTLVTVSS

SEQ ID NO: 370 - protein, 330 aa, Artificial; identical to SEQ ID NO: 10
  Humanized antibody sequence

SEQ ID NO: 371 - DNA, 1350 bp, Artificial
  Humanized antibody sequence
caggagcagctggaggagtccgggggagacctggtcaagcctgagggatccctgacactcacctgcacagcctctggattctccttcagtagcagttactggatatgctgggtccgccaggctccagggaaggggctggagtggatcgcatgcattcgtgctggtggtgggaattactacgcgaactgggcgaaaggccgattcaccatctccagaacctcgtcgaccacggtgactctgcaaatgaccagtctgacagccgcggacacggccacctatttttgtgcgagcgatattaatgatgggtggcttggccaattcaacttgtggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 372 - DNA, 360 bp, Artificial
  Humanized antibody sequence
caggagcagctggaggagtccgggggagacctggtcaagcctgagggatccctgacactcacctgcacagcctctggattctccttcagtagcagttactggatatgctgggtccgccaggctccagggaaggggctggagtggatcgcatgcattcgtgctggtggtgggaattactacgcgaactgggcgaaaggccgattcaccatctccagaacctcgtcgaccacggtgactctgcaaatgaccagtctgacagccgcggacacggccacctatttttgtgcgagcgatattaatgatgggtggcttggccaattcaacttgtggggcccgggcaccctggtcaccgtctcgagc

SEQ ID NO: 373 - DNA, 90 bp, Oryctolagus cuniculus; identical to SEQ ID NO: 213

SEQ ID NO: 374 - DNA, 18 bp, Oryctolagus cuniculus
agcagttactggatatgc

SEQ ID NO: 375 - DNA, 42 bp, Oryctolagus cuniculus
tgggtccgccaggctccagggaaggggctggagtggatcgca

SEQ ID NO: 376 - DNA, 48 bp, Oryctolagus cuniculus
tgcattcgtgctggtggtgggaattactacgcgaactgggcgaaaggc

SEQ ID NO: 377 - DNA, 93 bp, Oryctolagus cuniculus
cgattcaccatctccagaacctcgtcgaccacggtgactctgcaaatgaccagtctgacagccgcggacacggccacctatttttgtgcgagc

SEQ ID NO: 378 - DNA, 36 bp, Oryctolagus cuniculus; identical to SEQ ID NO: 218

SEQ ID NO: 379 - DNA, 33 bp, Artificial
  Humanized antibody sequence
tggggcccgggcaccctggtcaccgtctcgagc

SEQ ID NO: 380 - DNA, 990 bp, Artificial; identical to SEQ ID NO: 20
  Humanized antibody sequence

SEQ ID NO: 381 - protein, 220 aa, Artificial
  Humanized antibody sequence
ANIVMTQTPASVEAAVGGTVTIKCQASQSISNYLAWYQQKPGQPPKLLIYRTSTLASGVPSRFKGSGSGTQFTLTISDLECADAATYYCQSYYSVTTVAYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 113 aa, Artificial
  Humanized antibody sequence
ANIVMTQTPASVEAAVGGTVTIKCQASQSISNYLAWYQQKPGQPPKLLIYRTSTLASGVPSRFKGSGSGTQFTLTISDLECADAATYYCQSYYSVTTVAYGNTFGGGTEVVVK

SEQ ID NO: 383 - protein, 24 aa, Oryctolagus cuniculus
ANIVMTQTPASVEAAVGGTVTIKC

SEQ ID NO: 384 - protein, 11 aa, Oryctolagus cuniculus
QASQSISNYLA

SEQ ID NO: 385 - protein, 15 aa, Oryctolagus cuniculus
WYQQKPGQPPKLLIY

SEQ ID NO: 386 - protein, 7 aa, Oryctolagus cuniculus
RTSTLAS

SEQ ID NO: 387 - protein, 32 aa, Oryctolagus cuniculus; identical to SEQ ID NO: 227

SEQ ID NO: 388 - protein, 14 aa, Oryctolagus cuniculus
QSYYSVTTVAYGNT

SEQ ID NO: 389 - protein, 10 aa, Artificial
  Humanized antibody sequence
FGGGTEVVVK

SEQ ID NO: 390 - protein, 107 aa, Artificial [sequence omitted]

SEQ ID NO: 391 - DNA, 660 bp, Artificial
  Humanized antibody sequence
gccaacattgtgatgacccagactccagcctccgtggaggcagctgtgggaggcacagtcaccatcaagtgccaggccagtcagagcattagtaattacttagcctggtatcagcagaaaccagggcagcctcccaagctcctgatctacaggacatccactctggcatctggggtcccatcgcggttcaaaggcagtggatccgggacacagttcactctcaccatcagcgacctggagtgtgccgatgctgccacttactactgtcaaagctattattccgttactactgttgcttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 392 - DNA, 339 bp, Artificial
  Humanized antibody sequence
gccaacattgtgatgacccagactccagcctccgtggaggcagctgtgggaggcacagtcaccatcaagtgccaggccagtcagagcattagtaattacttagcctggtatcagcagaaaccagggcagcctcccaagctcctgatctacaggacatccactctggcatctggggtcccatcgcggttcaaaggcagtggatccgggacacagttcactctcaccatcagcgacctggagtgtgccgatgctgccacttactactgtcaaagctattattccgttactactgttgcttatggaaatactttcggcggagggaccgaggtggtggtcaaa

SEQ ID NO: 393 - DNA, 72 bp, Oryctolagus cuniculus
gccaacattgtgatgacccagactccagcctccgtggaggcagctgtgggaggcacagtcaccatcaagtgc

SEQ ID NO: 394 - DNA, 33 bp, Oryctolagus cuniculus
caggccagtcagagcattagtaattacttagcc

SEQ ID NO: 395 - DNA, 45 bp, Oryctolagus cuniculus; identical to SEQ ID NO: 235

SEQ ID NO: 396 - DNA, 21 bp, Oryctolagus cuniculus
aggacatccactctggcatct

SEQ ID NO: 397 - DNA, 96 bp, Oryctolagus cuniculus
ggggtcccatcgcggttcaaaggcagtggatccgggacacagttcactctcaccatcagcgacctggagtgtgccgatgctgccacttactactgt

SEQ ID NO: 398 - DNA, 42 bp, Oryctolagus cuniculus
caaagctattattccgttactactgttgcttatggaaatact

SEQ ID NO: 399 - DNA, 30 bp, Artificial; identical to SEQ ID NO: 39
  Humanized antibody sequence

SEQ ID NO: 400 - DNA, 321 bp, Artificial; identical to SEQ ID NO: 40
  Humanized antibody sequence

SEQ ID NO: 401 - protein, 451 aa, Artificial
  Humanized antibody sequence
EVQLVESGGGLVQPGGSLRLSCAASGFTVSSSYWICWVRQAPGKGLEWIACIRAGGGNYYANSAKGRFTISRDNSKNTLYLQMNSLRAEDTAVYYCASDINDGWLGQFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 121 aa, Artificial
  Humanized antibody sequence
EVQLVESGGGLVQPGGSLRLSCAASGFTVSSSYWICWVRQAPGKGLEWIACIRAGGGNYYANSAKGRFTISRDNSKNTLYLQMNSLRAEDTAVYYCASDINDGWLGQFNLWGQGTLVTVSS

SEQ ID NO: 403 - protein, 30 aa, Artificial; identical to SEQ ID NO: 243
  Humanized antibody sequence

SEQ ID NO: 404 - protein, 6 aa, Oryctolagus cuniculus
SSYWIC

SEQ ID NO: 405 - protein, 14 aa, Artificial
  Humanized antibody sequence
WVRQAPGKGLEWIA

SEQ ID NO: 406 - protein, 16 aa, Artificial
  Humanized antibody sequence
CIRAGGGNYYANSAKG

SEQ ID NO: 407 - protein, 32 aa, Artificial; identical to SEQ ID NO: 247
  Humanized antibody sequence

SEQ ID NO: 408 - protein, 12 aa, Oryctolagus cuniculus
DINDGWLGQFNL

SEQ ID NO: 409 - protein, 11 aa, Artificial
  Humanized antibody sequence
WGQGTLVTVSS

SEQ ID NO: 410 - protein, 330 aa, Artificial; identical to SEQ ID NO: 10
  Humanized antibody sequence

SEQ ID NO: 411 - DNA, 1353 bp, Artificial
  Humanized antibody sequence
gaggtgcagcttgtggagtctgggggaggcttggtccagcctggggggtccctgagactctcctgtgcagcctctggattcaccgtcagtagcagttactggatatgctgggtccgtcaggctccagggaaggggctggagtggatcgcatgcattcgtgctggtggtgggaattactacgctaactctgctaaaggccgattcaccatctccagagacaattccaagaacaccctgtatcttcaaatgaacagcctgagagctgaggacactgctgtgtattactgtgctagcgatatcaatgatgggtggcttggccaattcaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 412 - DNA, 363 bp, Artificial
  Humanized antibody sequence
gaggtgcagcttgtggagtctgggggaggcttggtccagcctggggggtccctgagactctcctgtgcagcctctggattcaccgtcagtagcagttactggatatgctgggtccgtcaggctccagggaaggggctggagtggatcgcatgcattcgtgctggtggtgggaattactacgctaactctgctaaaggccgattcaccatctccagagacaattccaagaacaccctgtatcttcaaatgaacagcctgagagctgaggacactgctgtgtattactgtgctagcgatatcaatgatgggtggcttggccaattcaacttgtggggccaagggaccctcgtcaccgtctcgagc

SEQ ID NO: 413 - DNA, 90 bp, Artificial; identical to SEQ ID NO: 253
  Humanized antibody sequence

SEQ ID NO: 414 - DNA, 18 bp, Oryctolagus cuniculus
agcagttactggatatgc

SEQ ID NO: 415 - DNA, 42 bp, Artificial
  Humanized antibody sequence
tgggtccgtcaggctccagggaaggggctggagtggatcgca

SEQ ID NO: 416 - DNA, 48 bp, Artificial
  Humanized antibody sequence
tgcattcgtgctggtggtgggaattactacgctaactctgctaaaggc

SEQ ID NO: 417 - DNA, 96 bp, Artificial; identical to SEQ ID NO: 257
  Humanized antibody sequence

SEQ ID NO: 418 - DNA, 36 bp, Artificial; identical to SEQ ID NO: 258
  Humanized antibody sequence

SEQ ID NO: 419 - DNA, 33 bp, Artificial; identical to SEQ ID NO: 259
  Humanized antibody sequence

SEQ ID NO: 420 - DNA, 990 bp, Artificial; identical to SEQ ID NO: 20
  Humanized antibody sequence

SEQ ID NO: 421 - protein, 220 aa, Artificial
  Humanized antibody sequence
ANIVMTQSPSSLSASVGDRVTITCQASQSISNYLAWYQQKPGKVPKLLIYRTSTLASGVPSRFSGSGSGTDFTLTISSLQPEDVATYYCQSYYSVTTVAYGNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 113 aa, Artificial
  Humanized antibody sequence
ANIVMTQSPSSLSASVGDRVTITCQASQSISNYLAWYQQKPGKVPKLLIYRTSTLASGVPSRFSGSGSGTDFTLTISSLQPEDVATYYCQSYYSVTTVAYGNTFGGGTKVEIK

SEQ ID NO: 423 - protein, 24 aa, Artificial
  Humanized antibody sequence
ANIVMTQSPSSLSASVGDRVTITC

SEQ ID NO: 424 - protein, 11 aa, Oryctolagus cuniculus
QASQSISNYLA

SEQ ID NO: 425 - protein, 15 aa, Artificial
  Humanized antibody sequence
WYQQKPGKVPKLLIY

SEQ ID NO: 426 - protein, 7 aa, Oryctolagus cuniculus
RTSTLAS

SEQ ID NO: 427 - protein, 32 aa, Artificial; identical to SEQ ID NO: 267
  Humanized antibody sequence

SEQ ID NO: 428 - protein, 14 aa, Oryctolagus cuniculus
QSYYSVTTVAYGNT

SEQ ID NO: 429 - protein, 10 aa, Artificial
  Humanized antibody sequence
FGGGTKVEIK

SEQ ID NO: 430 - protein, 107 aa, Artificial [sequence omitted]

SEQ ID NO: 431 - DNA, 660 bp, Artificial
  Humanized antibody sequence
gccaacattgtgatgacccagtctccatcctccctgtctgcatctgtaggagacagagtcaccatcacttgccaggccagtcagagcattagtaattacttagcctggtatcagcagaaaccagggaaagtccctaagctcctgatctataggacatccactctggcatctggggtcccatctcgtttcagtggcagtggatctgggacagatttcactctcaccatcagcagcctgcagcctgaagatgttgcaacttattactgtcaaagctactattccgttactactgttgcttatggaaatactttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 432 - DNA, 339 bp, Artificial
  Humanized antibody sequence
gccaacattgtgatgacccagtctccatcctccctgtctgcatctgtaggagacagagtcaccatcacttgccaggccagtcagagcattagtaattacttagcctggtatcagcagaaaccagggaaagtccctaagctcctgatctataggacatccactctggcatctggggtcccatctcgtttcagtggcagtggatctgggacagatttcactctcaccatcagcagcctgcagcctgaagatgttgcaacttattactgtcaaagctactattccgttactactgttgcttatggaaatactttcggcggaggaaccaaggtggaaatcaaa

SEQ ID NO: 433 - DNA, 72 bp, Artificial
  Humanized antibody sequence
gccaacattgtgatgacccagtctccatcctccctgtctgcatctgtaggagacagagtcaccatcacttgc

SEQ ID NO: 434 - DNA, 33 bp, Oryctolagus cuniculus; identical to SEQ ID NO: 394

SEQ ID NO: 435 - DNA, 45 bp, Artificial; identical to SEQ ID NO: 275
  Humanized antibody sequence

SEQ ID NO: 436 - DNA, 21 bp, Oryctolagus cuniculus
aggacatccactctggcatct

SEQ ID NO: 437 - DNA, 96 bp, Artificial; identical to SEQ ID NO: 277
  Humanized antibody sequence

SEQ ID NO: 438 - DNA, 42 bp, Artificial
  Humanized antibody sequence
caaagctactattccgttactactgttgcttatggaaatact

SEQ ID NO: 439 - DNA, 30 bp, Artificial; identical to SEQ ID NO: 279
  Humanized antibody sequence

SEQ ID NO: 440 - DNA, 321 bp, Artificial; identical to SEQ ID NO: 280
  Humanized antibody sequence

SEQ ID NO: 441 - protein, 451 aa, Artificial; identical to SEQ ID NO: 401
  Humanized antibody sequence

SEQ ID NO: 442 - protein, 121 aa, Artificial; identical to SEQ ID NO: 402
  Humanized antibody sequence

SEQ ID NO: 443 - protein, 30 aa, Artificial; identical to SEQ ID NO: 243
  Humanized antibody sequence

SEQ ID NO: 444 - protein, 6 aa, Oryctolagus cuniculus
SSYWIC

SEQ ID NO: 445 - protein, 14 aa, Artificial
  Humanized antibody sequence
WVRQAPGKGLEWIA

SEQ ID NO: 446 - protein, 16 aa, Artificial
  Humanized antibody sequence
CIRAGGGNYYANSAKG

SEQ ID NO: 447 - protein, 32 aa, Artificial; identical to SEQ ID NO: 247
  Humanized antibody sequence

SEQ ID NO: 448 - protein, 12 aa, Oryctolagus cuniculus
DINDGWLGQFNL

SEQ ID NO: 449 - protein, 11 aa, Artificial
  Humanized antibody sequence
WGQGTLVTVSS

SEQ ID NO: 450 - protein, 330 aa, Artificial; identical to SEQ ID NO: 10
  Humanized antibody sequence

SEQ ID NO: 451 - DNA, 1353 bp, Artificial; identical to SEQ ID NO: 411
  Humanized antibody sequence

SEQ ID NO: 452 - DNA, 363 bp, Artificial; identical to SEQ ID NO: 412
  Humanized antibody sequence

SEQ ID NO: 453 - DNA, 90 bp, Artificial; identical to SEQ ID NO: 253
  Humanized antibody sequence

SEQ ID NO: 454 - DNA, 18 bp, Oryctolagus cuniculus
agcagttactggatatgc

SEQ ID NO: 455 - DNA, 42 bp, Artificial; identical to SEQ ID NO: 415
  Humanized antibody sequence

SEQ ID NO: 456 - DNA, 48 bp, Artificial; identical to SEQ ID NO: 416
  Humanized antibody sequence

SEQ ID NO: 457 - DNA, 96 bp, Artificial; identical to SEQ ID NO: 257
  Humanized antibody sequence

SEQ ID NO: 458 - DNA, 36 bp, Artificial; identical to SEQ ID NO: 258
  Humanized antibody sequence

SEQ ID NO: 459 - DNA, 33 bp, Artificial; identical to SEQ ID NO: 259
  Humanized antibody sequence

SEQ ID NO: 460 - DNA, 990 bp, Artificial; identical to SEQ ID NO: 20
  Humanized antibody sequence

SEQ ID NO: 461 - protein, 220 aa, Artificial
  Humanized antibody sequence
ANIVMTQSPSSLSASVGDRVTIKCQASQSISNYLAWYQQKPGKVPKLLIYRTSTLASGVPSRFSGSGSGTDFTLTISSLQPEDVATYYCQSYYSVTTVAYGNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - protein, 113 aa, Artificial
  Humanized antibody sequence
ANIVMTQSPSSLSASVGDRVTIKCQASQSISNYLAWYQQKPGKVPKLLIYRTSTLASGVPSRFSGSGSGTDFTLTISSLQPEDVATYYCQSYYSVTTVAYGNTFGGGTKVEIK

SEQ ID NO: 463 - protein, 24 aa, Artificial
  Humanized antibody sequence
ANIVMTQSPSSLSASVGDRVTIKC

SEQ ID NO: 464 - protein, 11 aa, Oryctolagus cuniculus
QASQSISNYLA

SEQ ID NO: 465 - protein, 15 aa, Artificial
  Humanized antibody sequence
WYQQKPGKVPKLLIY

SEQ ID NO: 466 - protein, 7 aa, Oryctolagus cuniculus
RTSTLAS

SEQ ID NO: 467 - protein, 32 aa, Artificial; identical to SEQ ID NO: 267
  Humanized antibody sequence

SEQ ID NO: 468 - protein, 14 aa, Oryctolagus cuniculus
QSYYSVTTVAYGNT

SEQ ID NO: 469 - protein, 10 aa, Artificial
  Humanized antibody sequence
FGGGTKVEIK

SEQ ID NO: 470 - protein, 107 aa, Artificial [sequence omitted]

SEQ ID NO: 471 - DNA, 660 bp, Artificial
  Humanized antibody sequence
gccaacattgtgatgacccagtctccatcctccctgtctgcatctgtaggagacagagtcaccatcaagtgccaggccagtcagagcattagtaattacttagcctggtatcagcagaaaccagggaaagtccctaagctcctgatctataggacatccactctggcatctggggtcccatctcgtttcagtggcagtggatctgggacagatttcactctcaccatcagcagcctgcagcctgaagatgttgcaacttattactgtcaaagctactattccgttactactgttgcttatggaaatactttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 472 - DNA, 339 bp, Artificial
  Humanized antibody sequence
gccaacattgtgatgacccagtctccatcctccctgtctgcatctgtaggagacagagtcaccatcaagtgccaggccagtcagagcattagtaattacttagcctggtatcagcagaaaccagggaaagtccctaagctcctgatctataggacatccactctggcatctggggtcccatctcgtttcagtggcagtggatctgggacagatttcactctcaccatcagcagcctgcagcctgaagatgttgcaacttattactgtcaaagctactattccgttactactgttgcttatggaaatactttcggcggaggaaccaaggtggaaatcaaa

SEQ ID NO: 473 - DNA, 72 bp, Artificial
  Humanized antibody sequence
gccaacattgtgatgacccagtctccatcctccctgtctgcatctgtaggagacagagtcaccatcaagtgc

SEQ ID NO: 474 - DNA, 33 bp, Oryctolagus cuniculus; identical to SEQ ID NO: 394

SEQ ID NO: 475 - DNA, 45 bp, Artificial; identical to SEQ ID NO: 275
  Humanized antibody sequence

SEQ ID NO: 476 - DNA, 21 bp, Oryctolagus cuniculus
aggacatccactctggcatct

SEQ ID NO: 477 - DNA, 96 bp, Artificial; identical to SEQ ID NO: 277
  Humanized antibody sequence

SEQ ID NO: 478 - DNA, 42 bp, Artificial; identical to SEQ ID NO: 438
  Humanized antibody sequence

SEQ ID NO: 479 - DNA, 30 bp, Artificial; identical to SEQ ID NO: 279
  Humanized antibody sequence

SEQ ID NO: 480 - DNA, 321 bp, Artificial; identical to SEQ ID NO: 280
  Humanized antibody sequence

SEQ ID NO: 481 - protein, 450 aa, Artificial
  Humanized antibody sequence
QSVEESGGRLVTPGTPLTLTCTVSGIDLSTYGVGWVRQAPGKGLEYIGIISSSGSTYYASWAKGRFTISKTSSTTVDLKMTSLTTEDTATYFCARDWSSTTGYYGYFNMWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 120 aa, Artificial
  Humanized antibody sequence
QSVEESGGRLVTPGTPLTLTCTVSGIDLSTYGVGWVRQAPGKGLEYIGIISSSGSTYYASWAKGRFTISKTSSTTVDLKMTSLTTEDTATYFCARDWSSTTGYYGYFNMWGPGTLVTVSS

SEQ ID NO: 483 - protein, 29 aa, Oryctolagus cuniculus
QSVEESGGRLVTPGTPLTLTCTVSGIDLS

SEQ ID NO: 484 - protein, 5 aa, Oryctolagus cuniculus
TYGVG

SEQ ID NO: 485 - protein, 14 aa, Oryctolagus cuniculus
WVRQAPGKGLEYIG

SEQ ID NO: 486 - protein, 16 aa, Oryctolagus cuniculus
IISSSGSTYYASWAKG

SEQ ID NO: 487 - protein, 31 aa, Oryctolagus cuniculus
RFTISKTSSTTVDLKMTSLTTEDTATYFCAR

SEQ ID NO: 488 - protein, 14 aa, Oryctolagus cuniculus
DWSSTTGYYGYFNM

SEQ ID NO: 489 - protein, 11 aa, Artificial
  Humanized antibody sequence
WGPGTLVTVSS

SEQ ID NO: 490 - protein, 330 aa, Artificial; identical to SEQ ID NO: 10
  Humanized antibody sequence

SEQ ID NO: 491 - DNA, 1350 bp, Artificial
  Humanized antibody sequence
cagtcggtggaggagtccgggggtcgcctggtcacgcctgggacacccctgacactcacctgcacagtctctggaatcgacctcagtacctatggagtgggctgggtccgccaggctccagggaaggggctggaatacatcggaatcattagtagtagtggtagcacatactacgcgagctgggcgaaaggccgattcaccatctccaaaacctcgtcgaccacggtggatctgaaaatgaccagtctgacaaccgaggacacggccacctatttctgtgccagagattggtctagtactactggttattatgggtattttaatatgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 492 - DNA, 360 bp, Artificial
  Humanized antibody sequence
cagtcggtggaggagtccgggggtcgcctggtcacgcctgggacacccctgacactcacctgcacagtctctggaatcgacctcagtacctatggagtgggctgggtccgccaggctccagggaaggggctggaatacatcggaatcattagtagtagtggtagcacatactacgcgagctgggcgaaaggccgattcaccatctccaaaacctcgtcgaccacggtggatctgaaaatgaccagtctgacaaccgaggacacggccacctatttctgtgccagagattggtctagtactactggttattatgggtattttaatatgtggggcccgggcaccctcgtcaccgtctcgagc

SEQ ID NO: 493 - DNA, 87 bp, Oryctolagus cuniculus; identical to SEQ ID NO: 133

SEQ ID NO: 494 - DNA, 15 bp, Oryctolagus cuniculus
acctatggagtgggc

SEQ ID NO: 495 - DNA, 42 bp, Oryctolagus cuniculus; identical to SEQ ID NO: 15

SEQ ID NO: 496 - DNA, 48 bp, Oryctolagus cuniculus
atcattagtagtagtggtagcacatactacgcgagctgggcgaaaggc

SEQ ID NO: 497 - DNA, 93 bp, Oryctolagus cuniculus
cgattcaccatctccaaaacctcgtcgaccacggtggatctgaaaatgaccagtctgacaaccgaggacacggccacctatttctgtgccaga

SEQ ID NO: 498 - DNA, 42 bp, Oryctolagus cuniculus
gattggtctagtactactggttattatgggtattttaatatg

SEQ ID NO: 499 - DNA, 33 bp, Artificial; identical to SEQ ID NO: 19
  Humanized antibody sequence

SEQ ID NO: 500 - DNA, 990 bp, Artificial; identical to SEQ ID NO: 20
  Humanized antibody sequence

SEQ ID NO: 501 - protein, 215 aa, Artificial
  Humanized antibody sequence
AFELTQTPSPVSAAVGGTVTIKCQASQSISTALAWYQQKPGQPPKLLIYGASNLESGVPSRFSGSGSGTQFTLTISDLECADAAIYYCQSSYGSSTLAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 108 aa, Artificial
  Humanized antibody sequence
AFELTQTPSPVSAAVGGTVTIKCQASQSISTALAWYQQKPGQPPKLLIYGASNLESGVPSRFSGSGSGTQFTLTISDLECADAAIYYCQSSYGSSTLAFGGGTEVVVK

SEQ ID NO: 503 - protein, 23 aa, Oryctolagus cuniculus
AFELTQTPSPVSAAVGGTVTIKC

SEQ ID NO: 504 - protein, 11 aa, Oryctolagus cuniculus
QASQSISTALA

SEQ ID NO: 505 - protein, 15 aa, Oryctolagus cuniculus
WYQQKPGQPPKLLIY

SEQ ID NO: 506 - protein, 7 aa, Oryctolagus cuniculus
GASNLES

SEQ ID NO: 507 - protein, 32 aa, Oryctolagus cuniculus
GVPSRFSGSGSGTQFTLTISDLECADAAIYYC

SEQ ID NO: 508 - protein, 10 aa, Oryctolagus cuniculus
QSSYGSSTLA

SEQ ID NO: 509 - protein, 10 aa, Artificial
  Humanized antibody sequence
FGGGTEVVVK

SEQ ID NO: 510 - protein, 107 aa, Artificial [sequence omitted]

SEQ ID NO: 511 - DNA, 645 bp, Artificial
  Humanized antibody sequence
gcattcgaattgacccagactccatcccccgtgtctgcagctgtgggaggcacagtcaccatcaagtgccaggccagtcagagcattagcactgcattagcctggtatcagcagaaaccagggcagcctcccaagctcctgatctatggtgcatccaatctggaatctggggtcccatcgcggttcagcggcagtggatctgggacacagttcactctcaccatcagcgacctggagtgtgccgatgctgccatttactactgtcaaagctcttatggtagtagtactttggctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 512 - DNA, 324 bp, Artificial
  Humanized antibody sequence
gcattcgaattgacccagactccatcccccgtgtctgcagctgtgggaggcacagtcaccatcaagtgccaggccagtcagagcattagcactgcattagcctggtatcagcagaaaccagggcagcctcccaagctcctgatctatggtgcatccaatctggaatctggggtcccatcgcggttcagcggcagtggatctgggacacagttcactctcaccatcagcgacctggagtgtgccgatgctgccatttactactgtcaaagctcttatggtagtagtactttggctttcggcggagggaccgaggtggtggtcaaa

SEQ ID NO: 513 - DNA, 69 bp, Oryctolagus cuniculus
gcattcgaattgacccagactccatcccccgtgtctgcagctgtgggaggcacagtcaccatcaagtgc

SEQ ID NO: 514 - DNA, 33 bp, Oryctolagus cuniculus; identical to SEQ ID NO: 354

SEQ ID NO: 515 - DNA, 45 bp, Oryctolagus cuniculus; identical to SEQ ID NO: 35

SEQ ID NO: 516 - DNA, 21 bp, Oryctolagus cuniculus
ggtgcatccaatctggaatct

SEQ ID NO: 517 - DNA, 96 bp, Oryctolagus cuniculus
ggggtcccatcgcggttcagcggcagtggatctgggacacagttcactctcaccatcagcgacctggagtgtgccgatgctgccatttactactgt

SEQ ID NO: 518 - DNA, 30 bp, Oryctolagus cuniculus
caaagctcttatggtagtagtactttggct

SEQ ID NO: 519 - DNA, 30 bp, Artificial; identical to SEQ ID NO: 39
  Humanized antibody sequence

SEQ ID NO: 520 - DNA, 321 bp, Artificial; identical to SEQ ID NO: 40
  Humanized antibody sequence

SEQ ID NO: 521 - protein, 451 aa, Artificial
  Humanized antibody sequence
QEQLEESGGDLVKPEGSLTLTCTGSGFSFSSIAYMCWIRQAPGKGLEWIGCIGSGSGNTYYANWAKGRFTISKSSSTTVTLQMTSLTAADTATYFCASDTNNGWLGQFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 121 aa, Artificial
  Humanized antibody sequence
QEQLEESGGDLVKPEGSLTLTCTGSGFSFSSIAYMCWIRQAPGKGLEWIGCIGSGSGNTYYANWAKGRFTISKSSSTTVTLQMTSLTAADTATYFCASDTNNGWLGQFNLWGQGTLVTVSS

SEQ ID NO: 523 - protein, 30 aa, Oryctolagus cuniculus
QEQLEESGGDLVKPEGSLTLTCTGSGFSFS

SEQ ID NO: 524 - protein, 6 aa, Oryctolagus cuniculus
SIAYMC

SEQ ID NO: 525 - protein, 14 aa, Oryctolagus cuniculus
WIRQAPGKGLEWIG

SEQ ID NO: 526 - protein, 17 aa, Oryctolagus cuniculus
CIGSGSGNTYYANWAKG

SEQ ID NO: 527 - protein, 31 aa, Oryctolagus cuniculus
RFTISKSSSTTVTLQMTSLTAADTATYFCAS

SEQ ID NO: 528 - protein, 12 aa, Oryctolagus cuniculus
DTNNGWLGQFNL

SEQ ID NO: 529 - protein, 11 aa, Artificial
  Humanized antibody sequence
WGQGTLVTVSS

SEQ ID NO: 530 - protein, 330 aa, Artificial; identical to SEQ ID NO: 10
  Humanized antibody sequence

SEQ ID NO: 531 - DNA, 1353 bp, Artificial
  Humanized antibody sequence
caggagcagctggaggagtccgggggagacctggtcaagcctgagggatccctgacactcacctgcacaggttctggattctccttcagtagcatcgcctacatgtgctggatccgccaggctccagggaaggggctggagtggatcggatgcattggttctggtagtgggaacacttactacgcgaactgggcgaaaggccgattcaccatctccaaaagctcgtcgaccacggtgactctgcaaatgaccagtctgacagccgcggacacggccacttatttctgtgcgagcgatactaataatgggtggcttggccaattcaacttgtggggccagggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - DNA, 363 bp, Artificial
  Humanized antibody sequence
caggagcagctggaggagtccgggggagacctggtcaagcctgagggatccctgacactcacctgcacaggttctggattctccttcagtagcatcgcctacatgtgctggatccgccaggctccagggaaggggctggagtggatcggatgcattggttctggtagtgggaacacttactacgcgaactgggcgaaaggccgattcaccatctccaaaagctcgtcgaccacggtgactctgcaaatgaccagtctgacagccgcggacacggccacttatttctgtgcgagcgatactaataatgggtggcttggccaattcaacttgtggggccagggcaccctcgtcaccgtctcgagc

SEQ ID NO: 533 - DNA, 90 bp, Oryctolagus cuniculus
caggagcagctggaggagtccgggggagacctggtcaagcctgagggatccctgacactcacctgcacaggttctggattctccttcagt

SEQ ID NO: 534 - DNA, 18 bp, Oryctolagus cuniculus
agcatcgcctacatgtgc

SEQ ID NO: 535 - DNA, 42 bp, Oryctolagus cuniculus
tggatccgccaggctccagggaaggggctggagtggatcgga

SEQ ID NO: 536 - DNA, 51 bp, Oryctolagus cuniculus
tgcattggttctggtagtgggaacacttactacgcgaactgggcgaaaggc

SEQ ID NO: 537 - DNA, 93 bp, Oryctolagus cuniculus
cgattcaccatctccaaaagctcgtcgaccacggtgactctgcaaatgaccagtctgacagccgcggacacggccacttatttctgtgcgagc

SEQ ID NO: 538 - DNA, 36 bp, Oryctolagus cuniculus
gatactaataatgggtggcttggccaattcaacttg

SEQ ID NO: 539 - DNA, 33 bp, Artificial
  Humanized antibody sequence
tggggccagggcaccctcgtcaccgtctcgagc

SEQ ID NO: 540 - DNA, 990 bp, Artificial; identical to SEQ ID NO: 20
  Humanized antibody sequence

SEQ ID NO: 541 - protein, 220 aa, Artificial
  Humanized antibody sequence
ADIVMTQTPASVSAAVGGTVTINCQASQSISSYLAWYQQKPGQPPKLLIYRASTLASGVPSRFKGSGSGTQFTLTISDLECADAATYYCQGYYSVTTNTYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 113 aa, Artificial
  Humanized antibody sequence
ADIVMTQTPASVSAAVGGTVTINCQASQSISSYLAWYQQKPGQPPKLLIYRASTLASGVPSRFKGSGSGTQFTLTISDLECADAATYYCQGYYSVTTNTYGNTFGGGTEVVVK

SEQ ID NO: 543 - protein, 24 aa, Oryctolagus cuniculus
ADIVMTQTPASVSAAVGGTVTINC

SEQ ID NO: 544 - protein, 11 aa, Oryctolagus cuniculus
QASQSISSYLA

SEQ ID NO: 545 - protein, 15 aa, Oryctolagus cuniculus
WYQQKPGQPPKLLIY

SEQ ID NO: 546 - protein, 7 aa, Oryctolagus cuniculus
RASTLAS

SEQ ID NO: 547 - protein, 32 aa, Oryctolagus cuniculus; identical to SEQ ID NO: 227

SEQ ID NO: 548 - protein, 14 aa, Oryctolagus cuniculus
QGYYSVTTNTYGNT

SEQ ID NO: 549 - protein, 10 aa, Artificial
  Humanized antibody sequence
FGGGTEVVVK

SEQ ID NO: 550 - protein, 107 aa, Artificial [sequence omitted]

SEQ ID NO: 551 - DNA, 660 bp, Artificial
  Humanized antibody sequence
gctgacattgtgatgacccagactccagcctcggtgtctgcagctgtgggaggcacagtcaccatcaattgccaggccagtcagagcattagtagctacttagcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaggctattattccgttactactaatacttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 552 - DNA, 339 bp, Artificial
  Humanized antibody sequence
gctgacattgtgatgacccagactccagcctcggtgtctgcagctgtgggaggcacagtcaccatcaattgccaggccagtcagagcattagtagctacttagcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaggctattattccgttactactaatacttatggaaatactttcggcggagggaccgaggtggtggtcaaa

SEQ ID NO: 553 - DNA, 72 bp, Oryctolagus cuniculus
gctgacattgtgatgacccagactccagcctcggtgtctgcagctgtgggaggcacagtcaccatcaattgc

SEQ ID NO: 554 - DNA, 33 bp, Oryctolagus cuniculus
caggccagtcagagcattagtagctacttagcc

SEQ ID NO: 555 - DNA, 45 bp, Oryctolagus cuniculus; identical to SEQ ID NO: 235

SEQ ID NO: 556 - DNA, 21 bp, Oryctolagus cuniculus
agggcatccactctggcatct

SEQ ID NO: 557 - DNA, 96 bp, Oryctolagus cuniculus; identical to SEQ ID NO: 237

SEQ ID NO: 558 - DNA, 42 bp, Oryctolagus cuniculus
caaggctattattccgttactactaatacttatggaaatact

SEQ ID NO: 559 - DNA, 30 bp, Artificial; identical to SEQ ID NO: 39
  Humanized antibody sequence

SEQ ID NO: 560 - DNA, 321 bp, Artificial; identical to SEQ ID NO: 40
  Humanized antibody sequence

SEQ ID NO: 561 - protein, 452 aa, Artificial
  Humanized antibody sequence
QEQLEESGGDLVKPEGSLTLTCTASGFSFSSSYWICWVRQAPGKGLEWIACIDAGNSGSTYYASWAKGRFTISKASSTTVTLQMTSLTAADTATYFCASDLNDGWLGQFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 122 aa, Artificial
  Humanized antibody sequence
QEQLEESGGDLVKPEGSLTLTCTASGFSFSSSYWICWVRQAPGKGLEWIACIDAGNSGSTYYASWAKGRFTISKASSTTVTLQMTSLTAADTATYFCASDLNDGWLGQFNLWGPGTLVTVSS

SEQ ID NO: 563 - protein, 30 aa, Oryctolagus cuniculus; identical to SEQ ID NO: 203

SEQ ID NO: 564 - protein, 6 aa, Oryctolagus cuniculus
SSYWIC

SEQ ID NO: 565 - protein, 14 aa, Oryctolagus cuniculus
WVRQAPGKGLEWIA

SEQ ID NO: 566 - protein, 18 aa, Oryctolagus cuniculus
CIDAGNSGSTYYASWAKG

SEQ ID NO: 567 - protein, 31 aa, Oryctolagus cuniculus
RFTISKASSTTVTLQMTSLTAADTATYFCAS

SEQ ID NO: 568 - protein, 12 aa, Oryctolagus cuniculus
DLNDGWLGQFNL

SEQ ID NO: 569 - protein, 11 aa, Artificial
  Humanized antibody sequence
WGPGTLVTVSS

SEQ ID NO: 570 - protein, 330 aa, Artificial; identical to SEQ ID NO: 10
  Humanized antibody sequence

SEQ ID NO: 571 - DNA, 1356 bp, Artificial
  Humanized antibody sequence
caggagcagctggaggagtccgggggagacctggtcaagcctgagggatccctgacactcacctgcacagcctctggattctccttcagtagcagctactggatatgctgggtccgccaggctccagggaagggactggagtggatcgcatgcattgatgctggtaatagtggtagcacttactacgcgagctgggcgaaaggccgattcaccatctccaaggcctcgtcgaccacggtgactctgcaaatgaccagtctgacagccgcggacacggccacctatttttgtgcgagcgatcttaatgatgggtggcttggccaattcaacttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 572 - DNA, 366 bp, Artificial
  Humanized antibody sequence
caggagcagctggaggagtccgggggagacctggtcaagcctgagggatccctgacactcacctgcacagcctctggattctccttcagtagcagctactggatatgctgggtccgccaggctccagggaagggactggagtggatcgcatgcattgatgctggtaatagtggtagcacttactacgcgagctgggcgaaaggccgattcaccatctccaaggcctcgtcgaccacggtgactctgcaaatgaccagtctgacagccgcggacacggccacctatttttgtgcgagcgatcttaatgatgggtggcttggccaattcaacttgtggggcccgggcaccctcgtcaccgtctcgagc

SEQ ID NO: 573 - DNA, 90 bp, Oryctolagus cuniculus; identical to SEQ ID NO: 213

SEQ ID NO: 574 - DNA, 18 bp, Oryctolagus cuniculus
agcagctactggatatgc

SEQ ID NO: 575 - DNA, 42 bp, Oryctolagus cuniculus
tgggtccgccaggctccagggaagggactggagtggatcgca

SEQ ID NO: 576 - DNA, 54 bp, Oryctolagus cuniculus
tgcattgatgctggtaatagtggtagcacttactacgcgagctgggcgaaaggc

SEQ ID NO: 577 - DNA, 93 bp, Oryctolagus cuniculus
cgattcaccatctccaaggcctcgtcgaccacggtgactctgcaaatgaccagtctgacagccgcggacacggccacctatttttgtgcgagc

SEQ ID NO: 578 - DNA, 36 bp, Oryctolagus cuniculus
gatcttaatgatgggtggcttggccaattcaacttg

SEQ ID NO: 579 - DNA, 33 bp, Artificial; identical to SEQ ID NO: 19
  Humanized antibody sequence

SEQ ID NO: 580 - DNA, 990 bp, Artificial; identical to SEQ ID NO: 20
  Humanized antibody sequence

SEQ ID NO: 581 - protein, 220 aa, Artificial
  Humanized antibody sequence
ANIVMTQTPSPVSGAVGGTVTIKCQASQSISDYLAWYQQKPGQPPKLLIYRASTLASGVPSRFRGSGSGTEYTLTITDLECADAATYYCQSYYSVTTNTYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 113 aa, Artificial
  Humanized antibody sequence
ANIVMTQTPSPVSGAVGGTVTIKCQASQSISDYLAWYQQKPGQPPKLLIYRASTLASGVPSRFRGSGSGTEYTLTITDLECADAATYYCQSYYSVTTNTYGNTFGGGTEVVVK

SEQ ID NO: 583 - protein, 24 aa, Oryctolagus cuniculus
ANIVMTQTPSPVSGAVGGTVTIKC

SEQ ID NO: 584 - protein, 11 aa, Oryctolagus cuniculus
QASQSISDYLA

SEQ ID NO: 585 - protein, 15 aa, Oryctolagus cuniculus
WYQQKPGQPPKLLIY

SEQ ID NO: 586 - protein, 7 aa, Oryctolagus cuniculus
RASTLAS

SEQ ID NO: 587 - protein, 32 aa, Oryctolagus cuniculus
GVPSRFRGSGSGTEYTLTITDLECADAATYYC

SEQ ID NO: 588 - protein, 14 aa, Oryctolagus cuniculus
QSYYSVTTNTYGNT

SEQ ID NO: 589 - protein, 10 aa, Artificial
  Humanized antibody sequence
FGGGTEVVVK

SEQ ID NO: 590 - protein, 107 aa, Artificial [sequence omitted]

SEQ ID NO: 591 - DNA, 660 bp, Artificial
  Humanized antibody sequence
gccaacatcgtgatgacccagactccatcccccgtgtctggagctgtgggaggcacagtcaccatcaagtgccaggccagtcagagcattagtgactacttagcctggtatcagcagaaaccagggcagcctcccaaactcctgatctacagggcatccactctggcatctggggtcccatcgcggttcagaggcagtggatctgggacagagtacactctcaccatcaccgacctggagtgtgccgatgctgccacttactactgtcaaagctattattccgttactactaatacttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 592 - DNA, 339 bp, Artificial
  Humanized antibody sequence
gccaacatcgtgatgacccagactccatcccccgtgtctggagctgtgggaggcacagtcaccatcaagtgccaggccagtcagagcattagtgactacttagcctggtatcagcagaaaccagggcagcctcccaaactcctgatctacagggcatccactctggcatctggggtcccatcgcggttcagaggcagtggatctgggacagagtacactctcaccatcaccgacctggagtgtgccgatgctgccacttactactgtcaaagctattattccgttactactaatacttatggaaatactttcggcggagggaccgaggtggtggtcaaa

SEQ ID NO: 593 - DNA, 72 bp, Oryctolagus cuniculus
gccaacatcgtgatgacccagactccatcccccgtgtctggagctgtgggaggcacagtcaccatcaagtgc

SEQ ID NO: 594 - DNA, 33 bp, Oryctolagus cuniculus
caggccagtcagagcattagtgactacttagcc

SEQ ID NO: 595 - DNA, 45 bp, Oryctolagus cuniculus
tggtatcagcagaaaccagggcagcctcccaaactcctgatctac

SEQ ID NO: 596 - DNA, 21 bp, Oryctolagus cuniculus
agggcatccactctggcatct

SEQ ID NO: 597 - DNA, 96 bp, Oryctolagus cuniculus
ggggtcccatcgcggttcagaggcagtggatctgggacagagtacactctcaccatcaccgacctggagtgtgccgatgctgccacttactactgt

SEQ ID NO: 598 - DNA, 42 bp, Oryctolagus cuniculus; identical to SEQ ID NO: 238

SEQ ID NO: 599 - DNA, 30 bp, Artificial; identical to SEQ ID NO: 39
  Humanized antibody sequence

SEQ ID NO: 600 - DNA, 321 bp, Artificial; identical to SEQ ID NO: 40
  Humanized antibody sequence

SEQ ID NO: 601 - protein, 450 aa, Artificial
  Humanized antibody sequence
QEQLVESGGGLVQPEGSLTLTCTASGFSFSSDYWICWVRQAPGKGLEWIGCIRDGGGSYYANWAKGRLTISMTSSTTVGLKMTSLTAADTATYFCASDINDGWLGQFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 120 aa, Artificial
  Humanized antibody sequence
QEQLVESGGGLVQPEGSLTLTCTASGFSFSSDYWICWVRQAPGKGLEWIGCIRDGGGSYYANWAKGRLTISMTSSTTVGLKMTSLTAADTATYFCASDINDGWLGQFNLWGPGTLVTVSS

SEQ ID NO: 603 - protein, 30 aa, Oryctolagus cuniculus
QEQLVESGGGLVQPEGSLTLTCTASGFSFS

SEQ ID NO: 604 - protein, 6 aa, Oryctolagus cuniculus
SDYWIC

SEQ ID NO: 605 - protein, 14 aa, Oryctolagus cuniculus
WVRQAPGKGLEWIG

SEQ ID NO: 606 - protein, 16 aa, Oryctolagus cuniculus
CIRDGGGSYYANWAKG

SEQ ID NO: 607 - protein, 31 aa, Oryctolagus cuniculus
RLTISMTSSTTVGLKMTSLTAADTATYFCAS

SEQ ID NO: 608 - protein, 12 aa, Oryctolagus cuniculus
DINDGWLGQFNL

SEQ ID NO: 609 - protein, 11 aa, Artificial
  Humanized antibody sequence
WGPGTLVTVSS

SEQ ID NO: 610 - protein, 330 aa, Artificial; identical to SEQ ID NO: 10
  Humanized antibody sequence

SEQ ID NO: 611 - DNA, 1350 bp, Artificial
  Humanized antibody sequence
caggagcagctggtggagtccgggggaggcctggtccagcctgagggatccctgacactcacctgcacagcctctggattctcctttagtagtgattactggatatgctgggtccgccaggctccagggaagggcctggagtggatcggatgcattcgtgatggtggtgggagttactacgcgaactgggcgaaaggccgactcaccatctccatgacctcgtcgaccacggtgggtctgaaaatgaccagtctgacagccgcggacacggccacgtatttttgtgcgagcgatattaatgatgggtggcttggccaattcaacttgtggggcccagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 612 - DNA, 360 bp, Artificial
  Humanized antibody sequence
caggagcagctggtggagtccgggggaggcctggtccagcctgagggatccctgacactcacctgcacagcctctggattctcctttagtagtgattactggatatgctgggtccgccaggctccagggaagggcctggagtggatcggatgcattcgtgatggtggtgggagttactacgcgaactgggcgaaaggccgactcaccatctccatgacctcgtcgaccacggtgggtctgaaaatgaccagtctgacagccgcggacacggccacgtatttttgtgcgagcgatattaatgatgggtggcttggccaattcaacttgtggggcccagggaccctcgtcaccgtctcgagc

SEQ ID NO: 613 - DNA, 90 bp, Oryctolagus cuniculus
caggagcagctggtggagtccgggggaggcctggtccagcctgagggatccctgacactcacctgcacagcctctggattctcctttagt

SEQ ID NO: 614 - DNA, 18 bp, Oryctolagus cuniculus
agtgattactggatatgc

SEQ ID NO: 615 - DNA, 42 bp, Oryctolagus cuniculus
tgggtccgccaggctccagggaagggcctggagtggatcgga

SEQ ID NO: 616 - DNA, 48 bp, Oryctolagus cuniculus
tgcattcgtgatggtggtgggagttactacgcgaactgggcgaaaggc

SEQ ID NO: 617 - DNA, 93 bp, Oryctolagus cuniculus
cgactcaccatctccatgacctcgtcgaccacggtgggtctgaaaatgaccagtctgacagccgcggacacggccacgtatttttgtgcgagc

SEQ ID NO: 618 - DNA, 36 bp, Oryctolagus cuniculus; identical to SEQ ID NO: 218

SEQ ID NO: 619 - DNA, 33 bp, Artificial; identical to SEQ ID NO: 59
  Humanized antibody sequence

SEQ ID NO: 620 - DNA, 990 bp, Artificial; identical to SEQ ID NO: 20
  Humanized antibody sequence

SEQ ID NO: 621 - protein, 220 aa, Artificial
  Humanized antibody sequence
ADIVMTQTPASVEAAVGGTVTIKCQASQSISSYLAWYQQKPGQPPKLLIYRASTLASGVPSRFSGSGSGTEFTLTISDLECADAATYYCQSYYSVTTVTYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 113 aa, Artificial
  Humanized antibody sequence
ADIVMTQTPASVEAAVGGTVTIKCQASQSISSYLAWYQQKPGQPPKLLIYRASTLASGVPSRFSGSGSGTEFTLTISDLECADAATYYCQSYYSVTTVTYGNTFGGGTEVVVK

SEQ ID NO: 623 - protein, 24 aa, Oryctolagus cuniculus
ADIVMTQTPASVEAAVGGTVTIKC

SEQ ID NO: 624 - protein, 11 aa, Oryctolagus cuniculus
QASQSISSYLA

SEQ ID NO: 625 - protein, 15 aa, Oryctolagus cuniculus
WYQQKPGQPPKLLIY

SEQ ID NO: 626 - protein, 7 aa, Oryctolagus cuniculus
RASTLAS

SEQ ID NO: 627 - protein, 32 aa, Oryctolagus cuniculus
GVPSRFSGSGSGTEFTLTISDLECADAATYYC

SEQ ID NO: 628 - protein, 14 aa, Oryctolagus cuniculus
QSYYSVTTVTYGNT

SEQ ID NO: 629 - protein, 10 aa, Artificial
  Humanized antibody sequence
FGGGTEVVVK

SEQ ID NO: 630 - protein, 107 aa, Artificial [sequence omitted]

SEQ ID NO: 631 - DNA, 660 bp, Artificial
  Humanized antibody sequence
gctgacattgtgatgacccagactccagcctccgtggaggcagctgtgggaggcacagtcaccatcaagtgccaggccagtcagagcattagtagctacttagcctggtatcagcagaaaccagggcagcctcccaagctcctgatctacagggcatccactctggcctctggggtcccatcgcggttcagcggcagtggatctgggacagagttcactctcaccatcagcgacctggagtgtgccgatgctgccacttactactgtcaaagctattattccgttactactgttacttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 632 - DNA, 339 bp, Artificial
  Humanized antibody sequence
gctgacattgtgatgacccagactccagcctccgtggaggcagctgtgggaggcacagtcaccatcaagtgccaggccagtcagagcattagtagctacttagcctggtatcagcagaaaccagggcagcctcccaagctcctgatctacagggcatccactctggcctctggggtcccatcgcggttcagcggcagtggatctgggacagagttcactctcaccatcagcgacctggagtgtgccgatgctgccacttactactgtcaaagctattattccgttactactgttacttatggaaatactttcggcggagggaccgaggtggtggtcaaa

SEQ ID NO: 633 - DNA, 72 bp, Oryctolagus cuniculus
gctgacattgtgatgacccagactccagcctccgtggaggcagctgtgggaggcacagtcaccatcaagtgc

SEQ ID NO: 634 - DNA, 33 bp, Oryctolagus cuniculus; identical to SEQ ID NO: 554

SEQ ID NO: 635 - DNA, 45 bp, Oryctolagus cuniculus; identical to SEQ ID NO: 235

SEQ ID NO: 636 - DNA, 21 bp, Oryctolagus cuniculus
agggcatccactctggcctct

SEQ ID NO: 637 - DNA, 96 bp, Oryctolagus cuniculus
ggggtcccatcgcggttcagcggcagtggatctgggacagagttcactctcaccatcagcgacctggagtgtgccgatgctgccacttactactgt

SEQ ID NO: 638 - DNA, 42 bp, Oryctolagus cuniculus
caaagctattattccgttactactgttacttatggaaatact

SEQ ID NO: 639 - DNA, 30 bp, Artificial; identical to SEQ ID NO: 39
  Humanized antibody sequence

SEQ ID NO: 640 - DNA, 321 bp, Artificial; identical to SEQ ID NO: 40
  Humanized antibody sequence

SEQ ID NO: 641 - protein, 450 aa, Artificial
  Humanized antibody sequence
QEQLEESGGDLVKPEGSLTLTCTASGFSFSSSYWICWVRQAPGKGLEWIGCIRPGSADYYASWAKGRFTISRASSSTVTLQMTSLTAADTATYFCASDINDGWLGQFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 120 aa, Artificial
  Humanized antibody sequence
QEQLEESGGDLVKPEGSLTLTCTASGFSFSSSYWICWVRQAPGKGLEWIGCIRPGSADYYASWAKGRFTISRASSSTVTLQMTSLTAADTATYFCASDINDGWLGQFNLWGPGTLVTVSS

SEQ ID NO: 643 - protein, 30 aa, Oryctolagus cuniculus; identical to SEQ ID NO: 203

SEQ ID NO: 644 - protein, 6 aa, Oryctolagus cuniculus
SSYWIC

SEQ ID NO: 645 - protein, 14 aa, Oryctolagus cuniculus
WVRQAPGKGLEWIG

SEQ ID NO: 646 - protein, 16 aa, Oryctolagus cuniculus
CIRPGSADYYASWAKG

SEQ ID NO: 647 - protein, 31 aa, Oryctolagus cuniculus
RFTISRASSSTVTLQMTSLTAADTATYFCAS

SEQ ID NO: 648 - protein, 12 aa, Oryctolagus cuniculus
DINDGWLGQFNL

SEQ ID NO: 649 - protein, 11 aa, Artificial
  Humanized antibody sequence
WGPGTLVTVSS

SEQ ID NO: 650 - protein, 330 aa, Artificial; identical to SEQ ID NO: 10
  Humanized antibody sequence

SEQ ID NO: 651 - DNA, 1350 bp, Artificial
  Humanized antibody sequence
caggagcagctggaggagtccgggggagacctggtcaagcctgagggatccctgacactcacctgcacagcctctggattctccttcagtagcagctactggatatgctgggtccgccaggctccagggaagggactggagtggatcggatgcattcgtcctggtagtgcggattactacgcgagctgggcgaaaggccgattcaccatctccagagcctcgtcgtccacggtgactctgcaaatgaccagtctgacagccgcggacacggccacctatttttgtgcgagcgatattaatgatgggtggcttggccaattcaacttgtggggcccaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 652 - DNA, 360 bp, Artificial
  Humanized antibody sequence
caggagcagctggaggagtccgggggagacctggtcaagcctgagggatccctgacactcacctgcacagcctctggattctccttcagtagcagctactggatatgctgggtccgccaggctccagggaagggactggagtggatcggatgcattcgtcctggtagtgcggattactacgcgagctgggcgaaaggccgattcaccatctccagagcctcgtcgtccacggtgactctgcaaatgaccagtctgacagccgcggacacggccacctatttttgtgcgagcgatattaatgatgggtggcttggccaattcaacttgtggggcccaggcaccctggtcaccgtctcgagc

SEQ ID NO: 653 - DNA, 90 bp, Oryctolagus cuniculus; identical to SEQ ID NO: 213

SEQ ID NO: 654 - DNA, 18 bp, Oryctolagus cuniculus
agcagctactggatatgc

SEQ ID NO: 655 - DNA, 42 bp, Oryctolagus cuniculus; identical to SEQ ID NO: 215

SEQ ID NO: 656 - DNA, 48 bp, Oryctolagus cuniculus
tgcattcgtcctggtagtgcggattactacgcgagctgggcgaaaggc

SEQ ID NO: 657 - DNA, 93 bp, Oryctolagus cuniculus
cgattcaccatctccagagcctcgtcgtccacggtgactctgcaaatgaccagtctgacagccgcggacacggccacctatttttgtgcgagc

SEQ ID NO: 658 - DNA, 36 bp, Oryctolagus cuniculus; identical to SEQ ID NO: 218

SEQ ID NO: 659 - DNA, 33 bp, Artificial
  Humanized antibody sequence
tggggcccaggcaccctggtcaccgtctcgagc

SEQ ID NO: 660 - DNA, 990 bp, Artificial; identical to SEQ ID NO: 20
  Humanized antibody sequence

SEQ ID NO: 661 - protein, 220 aa, Artificial
  Humanized antibody sequence
ADVVMTQTPASVEAAVGGTVTIKCQASLSIADYLAWYLQKPGQPPKLLIYRASTLASGVPSRFKGSGSGTEYTLTISDLECADAATYYCQSYYSVTTNTYGNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 113 aa, Artificial
  Humanized antibody sequence
ADVVMTQTPASVEAAVGGTVTIKCQASLSIADYLAWYLQKPGQPPKLLIYRASTLASGVPSRFKGSGSGTEYTLTISDLECADAATYYCQSYYSVTTNTYGNTFGGGTEVVVK

SEQ ID NO: 663 - protein, 24 aa, Oryctolagus cuniculus
ADVVMTQTPASVEAAVGGTVTIKC

SEQ ID NO: 664 - protein, 11 aa, Oryctolagus cuniculus
QASLSIADYLA

SEQ ID NO: 665 - protein, 15 aa, Oryctolagus cuniculus
WYLQKPGQPPKLLIY

SEQ ID NO: 666 - protein, 7 aa, Oryctolagus cuniculus
RASTLAS

SEQ ID NO: 667 - protein, 32 aa, Oryctolagus cuniculus
GVPSRFKGSGSGTEYTLTISDLECADAATYYC

SEQ ID NO: 668 - protein, 14 aa, Oryctolagus cuniculus
QSYYSVTTNTYGNT

SEQ ID NO: 669 - protein, 10 aa, Artificial
  Humanized antibody sequence
FGGGTEVVVK

SEQ ID NO: 670 - protein, 107 aa, Artificial [sequence omitted]

SEQ ID NO: 671 - DNA, 660 bp, Artificial
  Humanized antibody sequence
gccgatgttgtgatgacccagactccagcctccgtggaggcagctgtgggaggcacagtcaccatcaagtgccaggccagtctgagcattgctgactacttagcctggtatctccagaaaccagggcagcctcccaagctcctgatctacagggcatccactctggcatctggggtcccatcgcggttcaagggcagtggatctgggacagagtacactctcaccatcagcgacctggagtgtgccgatgctgccacttactactgtcaaagctattattccgttactactaatacttatggaaatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 672 - DNA, 339 bp, Artificial
  Humanized antibody sequence
gccgatgttgtgatgacccagactccagcctccgtggaggcagctgtgggaggcacagtcaccatcaagtgccaggccagtctgagcattgctgactacttagcctggtatctccagaaaccagggcagcctcccaagctcctgatctacagggcatccactctggcatctggggtcccatcgcggttcaagggcagtggatctgggacagagtacactctcaccatcagcgacctggagtgtgccgatgctgccacttactactgtcaaagctattattccgttactactaatacttatggaaatactttcggcggagggaccgaggtggtggtcaaa

SEQ ID NO: 673 - DNA, 72 bp, Oryctolagus cuniculus
gccgatgttgtgatgacccagactccagcctccgtggaggcagctgtgggaggcacagtcaccatcaagtgc

SEQ ID NO: 674 - DNA, 33 bp, Oryctolagus cuniculus
caggccagtctgagcattgctgactacttagcc

SEQ ID NO: 675 - DNA, 45 bp, Oryctolagus cuniculus
tggtatctccagaaaccagggcagcctcccaagctcctgatctac

SEQ ID NO: 676 - DNA, 21 bp, Oryctolagus cuniculus
agggcatccactctggcatct

SEQ ID NO: 677 - DNA, 96 bp, Oryctolagus cuniculus
ggggtcccatcgcggttcaagggcagtggatctgggacagagtacactctcaccatcagcgacctggagtgtgccgatgctgccacttactactgt

SEQ ID NO: 678 - DNA, 42 bp, Oryctolagus cuniculus; identical to SEQ ID NO: 238

SEQ ID NO: 679 - DNA, 30 bp, Artificial; identical to SEQ ID NO: 39
  Humanized antibody sequence

SEQ ID NO: 680 - DNA, 321 bp, Artificial; identical to SEQ ID NO: 40
  Humanized antibody sequence

SEQ ID NO: 681 - protein, 451 aa, Artificial
  Humanized antibody sequence
EVQLVESGGGLVQPGGSLRLSCAASGFTVSSNYWICWVRQAPGKGLEWIGCIRDGGGTYYASSAKGRFTISRDNSKNTLYLQMNSLRAEDTAVYYCASDINDGWLGQFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 121 aa, Artificial; identical to SEQ ID NO: 242
  Humanized antibody sequence

SEQ ID NO: 683 - protein, 30 aa, Artificial; identical to SEQ ID NO: 243
  Humanized antibody sequence

SEQ ID NO: 684 - protein, 6 aa, Oryctolagus cuniculus
SNYWIC

SEQ ID NO: 685 - protein, 14 aa, Artificial
  Humanized antibody sequence
WVRQAPGKGLEWIG

SEQ ID NO: 686 - protein, 16 aa, Artificial
  Humanized antibody sequence
CIRDGGGTYYASSAKG

SEQ ID NO: 687 - protein, 32 aa, Artificial; identical to SEQ ID NO: 247
  Humanized antibody sequence

SEQ ID NO: 688 - protein, 12 aa, Oryctolagus cuniculus
DINDGWLGQFNL

SEQ ID NO: 689 - protein, 11 aa, Artificial
  Humanized antibody sequence
WGQGTLVTVSS

SEQ ID NO: 690 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 691 - DNA, 1353 bp, Artificial
  Humanized antibody sequence
gaggtgcagcttgtggagtctgggggaggcttggtccagcctggggggtccctgagactctcctgtgcagcctctggattcaccgtcagtagcaactactggatatgctgggtccgtcaggctccagggaaggggctggagtggatcggatgcattcgtgatggtggtggcacttactacgctagctctgctaaaggccgattcaccatctccagagacaattccaagaacaccctgtatcttcaaatgaacagcctgagagctgaggacactgctgtgtattactgtgctagcgatatcaatgatgggtggcttggccaattcaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 692 - DNA, 363 bp, Artificial; identical to SEQ ID NO: 252
  Humanized antibody sequence

SEQ ID NO: 693 - DNA, 90 bp, Artificial; identical to SEQ ID NO: 253
  Humanized antibody sequence

SEQ ID NO: 694 - DNA, 18 bp, Oryctolagus cuniculus
agcaactactggatatgc

SEQ ID NO: 695 - DNA, 42 bp, Artificial; identical to SEQ ID NO: 255
  Humanized antibody sequence

SEQ ID NO: 696 - DNA, 48 bp, Artificial; identical to SEQ ID NO: 256
  Humanized antibody sequence

SEQ ID NO: 697 - DNA, 96 bp, Artificial; identical to SEQ ID NO: 257
  Humanized antibody sequence

SEQ ID NO: 698 - DNA, 36 bp, Artificial; identical to SEQ ID NO: 258
  Humanized antibody sequence

SEQ ID NO: 699 - DNA, 33 bp, Artificial; identical to SEQ ID NO: 259
  Humanized antibody sequence

SEQ ID NO: 700 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 701 - protein, 220 aa, Artificial; identical to SEQ ID NO: 261
  Humanized antibody sequence

SEQ ID NO: 702 - protein, 113 aa, Artificial; identical to SEQ ID NO: 262
  Humanized antibody sequence

SEQ ID NO: 703 - protein, 24 aa, Artificial
  Humanized antibody sequence
ADIVMTQSPSSLSASVGDRVTIKC

SEQ ID NO: 704 - protein, 11 aa, Oryctolagus cuniculus
QASQSISAYLA

SEQ ID NO: 705 - protein, 15 aa, Artificial
  Humanized antibody sequence
WYQQKPGKVPKLLIY

SEQ ID NO: 706 - protein, 7 aa, Oryctolagus cuniculus
RAYTLAS

SEQ ID NO: 707 - protein, 32 aa, Artificial; identical to SEQ ID NO: 267
  Humanized antibody sequence

SEQ ID NO: 708 - protein, 14 aa, Oryctolagus cuniculus
QSYYSVTTNTYGNT

SEQ ID NO: 709 - protein, 10 aa, Artificial
  Humanized antibody sequence
FGGGTKVEIK

SEQ ID NO: 710 - protein, 107 aa, Artificial [sequence omitted]

SEQ ID NO: 711 - DNA, 660 bp, Artificial; identical to SEQ ID NO: 271
  Humanized antibody sequence

SEQ ID NO: 712 - DNA, 339 bp, Artificial; identical to SEQ ID NO: 272
  Humanized antibody sequence

SEQ ID NO: 713 - DNA, 72 bp, Artificial; identical to SEQ ID NO: 273
  Humanized antibody sequence

SEQ ID NO: 714 - DNA, 33 bp, Artificial; identical to SEQ ID NO: 274
  Humanized antibody sequence

SEQ ID NO: 715 - DNA, 45 bp, Artificial; identical to SEQ ID NO: 275
  Humanized antibody sequence

SEQ ID NO: 716 - DNA, 21 bp, Oryctolagus cuniculus
agggcatacactctggcatct

SEQ ID NO: 717 - DNA, 96 bp, Artificial; identical to SEQ ID NO: 277
  Humanized antibody sequence

SEQ ID NO: 718 - DNA, 42 bp, Artificial; identical to SEQ ID NO: 278
  Humanized antibody sequence

SEQ ID NO: 719 - DNA, 30 bp, Artificial; identical to SEQ ID NO: 279
  Humanized antibody sequence

SEQ ID NO: 720 - DNA, 321 bp, Artificial; identical to SEQ ID NO: 280
  Humanized antibody sequence

SEQ ID NO: 721 - protein, 453 aa, Artificial
  Humanized antibody sequence
EVQLVESGGGLVQPGGSLRLSCAASGIDLSSYAMGWVRQAPGKGLEYIGIIVSYGPTYYASWAKGRFTISRDNSKNTVYLQMNSLRAEDTATYFCARDLDAQSSGYYGAFNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 123 aa, Artificial
  Humanized antibody sequence
EVQLVESGGGLVQPGGSLRLSCAASGIDLSSYAMGWVRQAPGKGLEYIGIIVSYGPTYYASWAKGRFTISRDNSKNTVYLQMNSLRAEDTATYFCARDLDAQSSGYYGAFNIWGQGTLVTVSS

SEQ ID NO: 723 - protein, 30 aa, Artificial
  Humanized antibody sequence
EVQLVESGGGLVQPGGSLRLSCAASGIDLS

SEQ ID NO: 724 - protein, 5 aa, Oryctolagus cuniculus
SYAMG

SEQ ID NO: 725 - protein, 14 aa, Artificial
  Humanized antibody sequence
WVRQAPGKGLEYIG

SEQ ID NO: 726 - protein, 16 aa, Oryctolagus cuniculus
IIVSYGPTYYASWAKG

SEQ ID NO: 727 - protein, 32 aa, Artificial
  Humanized antibody sequence
RFTISRDNSKNTVYLQMNSLRAEDTATYFCAR

SEQ ID NO: 728 - protein, 15 aa, Artificial
  Humanized antibody sequence
DLDAQSSGYYGAFNI

SEQ ID NO: 729 - protein, 11 aa, Artificial
  Humanized antibody sequence
WGQGTLVTVSS

SEQ ID NO: 730 - protein, 330 aa, Artificial; identical to SEQ ID NO: 10
  Humanized antibody sequence

SEQ ID NO: 731 - DNA, 1359 bp, Artificial
  Humanized antibody sequence
gaggtgcagcttgtggagtctgggggaggcttggtccagcctggggggtccctgagactctcctgtgcagcctctggaatcgacctcagtagctatgcaatgggctgggtccgtcaggctccagggaaggggctggagtacatcggaatcattgttagttatgggcccacatactacgctagctgggctaaaggccgattcaccatctccagagacaattccaagaacaccgtgtatcttcaaatgaacagcctgagagctgaggacactgccacctatttctgtgccagagatctggatgctcaaagtagtggttactatggagcttttaacatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 732 - DNA, 369 bp, Artificial
  Humanized antibody sequence
gaggtgcagcttgtggagtctgggggaggcttggtccagcctggggggtccctgagactctcctgtgcagcctctggaatcgacctcagtagctatgcaatgggctgggtccgtcaggctccagggaaggggctggagtacatcggaatcattgttagttatgggcccacatactacgctagctgggctaaaggccgattcaccatctccagagacaattccaagaacaccgtgtatcttcaaatgaacagcctgagagctgaggacactgccacctatttctgtgccagagatctggatgctcaaagtagtggttactatggagcttttaacatctggggccaagggaccctcgtcaccgtctcgagc

SEQ ID NO: 733 - DNA, 90 bp, Artificial
  Humanized antibody sequence
gaggtgcagcttgtggagtctgggggaggcttggtccagcctggggggtccctgagactctcctgtgcagcctctggaatcgacctcagt

SEQ ID NO: 734 - DNA, 15 bp, Oryctolagus cuniculus
agctatgcaatgggc

SEQ ID NO: 735 - DNA, 42 bp, Artificial
  Humanized antibody sequence
tgggtccgtcaggctccagggaaggggctggagtacatcgga

SEQ ID NO: 736 - DNA, 48 bp, Artificial
  Humanized antibody sequence
atcattgttagttatgggcccacatactacgctagctgggctaaaggc

SEQ ID NO: 737 - DNA, 96 bp, Artificial
  Humanized antibody sequence
cgattcaccatctccagagacaattccaagaacaccgtgtatcttcaaatgaacagcctgagagctgaggacactgccacctatttctgtgccaga

SEQ ID NO: 738 - DNA, 45 bp, Artificial
  Humanized antibody sequence
gatctggatgctcaaagtagtggttactatggagcttttaacatc

SEQ ID NO: 739 - DNA, 33 bp, Artificial; identical to SEQ ID NO: 259
  Humanized antibody sequence

SEQ ID NO: 740 - DNA, 990 bp, Artificial; identical to SEQ ID NO: 20
  Humanized antibody sequence

SEQ ID NO: 741 - protein, 215 aa, Artificial
  Humanized antibody sequence
DIQMTQSPSTLSASVGDRVTITCQASQSISTALAWYQQKPGKAPKLLIYAASPLASGVPSRFSGSGSGTEFTLTISSLQPDDFATYYCQSYYGSSNIAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 108 aa, Artificial
  Humanized antibody sequence
DIQMTQSPSTLSASVGDRVTITCQASQSISTALAWYQQKPGKAPKLLIYAASPLASGVPSRFSGSGSGTEFTLTISSLQPDDFATYYCQSYYGSSNIAFGGGTKVEIK

SEQ ID NO: 743 - protein, 23 aa, Artificial
  Humanized antibody sequence
DIQMTQSPSTLSASVGDRVTITC

SEQ ID NO: 744 - protein, 11 aa, Oryctolagus cuniculus
QASQSISTALA

SEQ ID NO: 745 - protein, 15 aa, Artificial
  Humanized antibody sequence
WYQQKPGKAPKLLIY

SEQ ID NO: 746 - protein, 7 aa, Oryctolagus cuniculus
AASPLAS

SEQ ID NO: 747 - protein, 32 aa, Artificial
  Humanized antibody sequence
GVPSRFSGSGSGTEFTLTISSLQPDDFATYYC

SEQ ID NO: 748 - protein, 10 aa, Oryctolagus cuniculus
QSYYGSSNIA

SEQ ID NO: 749 - protein, 10 aa, Artificial
  Humanized antibody sequence
FGGGTKVEIK

SEQ ID NO: 750 - protein, 107 aa, Artificial [sequence omitted]

SEQ ID NO: 751 - DNA, 645 bp, Artificial
  Humanized antibody sequence
gacatccagatgacccagtctccttccaccctgtctgcatctgtaggagacagagtcaccatcacttgtcaggccagtcagagcattagcactgcattagcctggtatcagcagaaaccaggaaaagcccctaagctcctgatctatgctgcatcccctctggcatctggagtcccatcaaggttcagcggcagtggatctggaacagaattcactctcaccatcagcagcctgcagcctgatgattttgcaacttactactgtcaaagctattatggtagtagcaacattgctttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 752 - DNA, 324 bp, Artificial
  Humanized antibody sequence
gacatccagatgacccagtctccttccaccctgtctgcatctgtaggagacagagtcaccatcacttgtcaggccagtcagagcattagcactgcattagcctggtatcagcagaaaccaggaaaagcccctaagctcctgatctatgctgcatcccctctggcatctggagtcccatcaaggttcagcggcagtggatctggaacagaattcactctcaccatcagcagcctgcagcctgatgattttgcaacttactactgtcaaagctattatggtagtagcaacattgctttcggcggaggaaccaaggtggaaatcaaa

SEQ ID NO: 753 - DNA, 69 bp, Artificial
  Humanized antibody sequence
gacatccagatgacccagtctccttccaccctgtctgcatctgtaggagacagagtcaccatcacttgt

SEQ ID NO: 754 - DNA, 33 bp, Oryctolagus cuniculus; identical to SEQ ID NO: 354

SEQ ID NO: 755 - DNA, 45 bp, Artificial
  Humanized antibody sequence
tggtatcagcagaaaccaggaaaagcccctaagctcctgatctat

SEQ ID NO: 756 - DNA, 21 bp, Oryctolagus cuniculus
gctgcatcccctctggcatct

SEQ ID NO: 757 - DNA, 96 bp, Artificial
  Humanized antibody sequence
ggagtcccatcaaggttcagcggcagtggatctggaacagaattcactctcaccatcagcagcctgcagcctgatgattttgcaacttactactgt

SEQ ID NO: 758 - DNA, 30 bp, Artificial
  Humanized antibody sequence
caaagctattatggtagtagcaacattgct

SEQ ID NO: 759 - DNA, 30 bp, Artificial; identical to SEQ ID NO: 279
  Humanized antibody sequence

SEQ ID NO: 760 - DNA, 321 bp, Artificial; identical to SEQ ID NO: 280
  Humanized antibody sequence

SEQ ID NO: 761 - protein, 453 aa, Artificial
  Humanized antibody sequence
EVQLVESGGGLVQPGGSLRLSCAASGIDLSSYAMGWVRQAPGKGLEYIGIIVSYGPTYYASWAKGRFTISRDNSKSTVYLQMNSLRAEDTATYFCARDLDAQSSGYYGAFNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 762 - protein, 123 aa, Artificial
  Humanized antibody sequence
EVQLVESGGGLVQPGGSLRLSCAASGIDLSSYAMGWVRQAPGKGLEYIGIIVSYGPTYYASWAKGRFTISRDNSKSTVYLQMNSLRAEDTATYFCARDLDAQSSGYYGAFNIWGQGTLVTVSS

SEQ ID NO: 763 - protein, 30 aa, Artificial; identical to SEQ ID NO: 723
  Humanized antibody sequence

SEQ ID NO: 764 - protein, 5 aa, Oryctolagus cuniculus
SYAMG

SEQ ID NO: 765 - protein, 14 aa, Artificial
  Humanized antibody sequence
WVRQAPGKGLEYIG

SEQ ID NO: 766 - protein, 16 aa, Oryctolagus cuniculus
IIVSYGPTYYASWAKG

SEQ ID NO: 767 - protein, 32 aa, Artificial
  Humanized antibody sequence
RFTISRDNSKSTVYLQMNSLRAEDTATYFCAR

SEQ ID NO: 768 - protein, 15 aa, Artificial
  Humanized antibody sequence
DLDAQSSGYYGAFNI

SEQ ID NO: 769 - protein, 11 aa, Artificial
  Humanized antibody sequence
WGQGTLVTVSS

SEQ ID NO: 770 - protein, 330 aa, Artificial; identical to SEQ ID NO: 10
  Humanized antibody sequence

SEQ ID NO: 771 - DNA, 1359 bp, Artificial
  Humanized antibody sequence
gaggtgcagcttgtggagtctgggggaggcttggtccagcctggggggtccctgagactctcctgtgcagcctctggaatcgacctcagtagctatgcaatgggctgggtccgtcaggctccagggaaggggctggagtacatcggaatcattgttagttatgggcccacatactacgctagctgggctaaaggccgattcaccatctccagagacaattccaagtccaccgtgtatcttcaaatgaacagcctgagagctgaggacactgccacctatttctgtgccagagatctggatgctcaaagtagtggttactatggagcttttaacatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 772 - DNA, 369 bp, Artificial
  Humanized antibody sequence
gaggtgcagcttgtggagtctgggggaggcttggtccagcctggggggtccctgagactctcctgtgcagcctctggaatcgacctcagtagctatgcaatgggctgggtccgtcaggctccagggaaggggctggagtacatcggaatcattgttagttatgggcccacatactacgctagctgggctaaaggccgattcaccatctccagagacaattccaagtccaccgtgtatcttcaaatgaacagcctgagagctgaggacactgccacctatttctgtgccagagatctggatgctcaaagtagtggttactatggagcttttaacatctggggccaagggaccctcgtcaccgtctcgagc

SEQ ID NO: 773 - DNA, 90 bp, Artificial; identical to SEQ ID NO: 733
  Humanized antibody sequence

SEQ ID NO: 774 - DNA, 15 bp, Oryctolagus cuniculus
agctatgcaatgggc

SEQ ID NO: 775 - DNA, 42 bp, Artificial; identical to SEQ ID NO: 735
  Humanized antibody sequence

SEQ ID NO: 776 - DNA, 48 bp, Artificial; identical to SEQ ID NO: 736
  Humanized antibody sequence

SEQ ID NO: 777 - DNA, 96 bp, Artificial
  Humanized antibody sequence
cgattcaccatctccagagacaattccaagtccaccgtgtatcttcaaatgaacagcctgagagctgaggacactgccacctatttctgtgccaga

SEQ ID NO: 778 - DNA, 45 bp, Artificial; identical to SEQ ID NO: 738
  Humanized antibody sequence

SEQ ID NO: 779 - DNA, 33 bp, Artificial; identical to SEQ ID NO: 259
  Humanized antibody sequence

SEQ ID NO: 780 - DNA, 990 bp, Artificial; identical to SEQ ID NO: 20
  Humanized antibody sequence

SEQ ID NO: 781 - protein, 215 aa, Artificial; identical to SEQ ID NO: 741
  Humanized antibody sequence

SEQ ID NO: 782 - protein, 108 aa, Artificial; identical to SEQ ID NO: 742
  Humanized antibody sequence

SEQ ID NO: 783 - protein, 23 aa, Artificial
  Humanized antibody sequence
DIQMTQSPSTLSASVGDRVTITC

SEQ ID NO: 784 - protein, 11 aa, Oryctolagus cuniculus
QASQSISTALA

SEQ ID NO: 785 - protein, 15 aa, Artificial
  Humanized antibody sequence
WYQQKPGKAPKLLIY

SEQ ID NO: 786 - protein, 7 aa, Oryctolagus cuniculus
AASPLAS

SEQ ID NO: 787 - protein, 32 aa, Artificial; identical to SEQ ID NO: 747
  Humanized antibody sequence

SEQ ID NO: 788 - protein, 10 aa, Oryctolagus cuniculus
QSYYGSSNIA

SEQ ID NO: 789 - protein, 10 aa, Artificial
  Humanized antibody sequence
FGGGTKVEIK

SEQ ID NO: 790 - protein, 107 aa, Artificial [sequence omitted]

SEQ ID NO: 791 - DNA, 645 bp, Artificial; identical to SEQ ID NO: 751
  Humanized antibody sequence

SEQ ID NO: 792 - DNA, 324 bp, Artificial; identical to SEQ ID NO: 752
  Humanized antibody sequence

SEQ ID NO: 793 - DNA, 69 bp, Artificial; identical to SEQ ID NO: 753
  Humanized antibody sequence

SEQ ID NO: 794 - DNA, 33 bp, Oryctolagus cuniculus; identical to SEQ ID NO: 354

SEQ ID NO: 795 - DNA, 45 bp, Artificial; identical to SEQ ID NO: 755
  Humanized antibody sequence

SEQ ID NO: 796 - DNA, 21 bp, Oryctolagus cuniculus
gctgcatcccctctggcatct

SEQ ID NO: 797 - DNA, 96 bp, Artificial; identical to SEQ ID NO: 757
  Humanized antibody sequence

SEQ ID NO: 798 - DNA, 30 bp, Artificial; identical to SEQ ID NO: 758
  Humanized antibody sequence

SEQ ID NO: 799 - DNA, 30 bp, Artificial; identical to SEQ ID NO: 279
  Humanized antibody sequence

SEQ ID NO: 800 - DNA, 321 bp, Artificial; identical to SEQ ID NO: 280
  Humanized antibody sequence

SEQ ID NO: 801 - protein, 448 aa, Artificial
  Humanized antibody sequence
QSVEESGGRLVTPGTPLTLTCTVSGFSLSSYAMNWVRQAPGKGLEWIGAIRSSGATFFASWVNGRFTISKTSTTVDLKITSPTPEDTATYFCARDTNDGWYINRLDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 802 - protein, 118 aa, Artificial
  Humanized antibody sequence
QSVEESGGRLVTPGTPLTLTCTVSGFSLSSYAMNWVRQAPGKGLEWIGAIRSSGATFFASWVNGRFTISKTSTTVDLKITSPTPEDTATYFCARDTNDGWYINRLDLWGPGTLVTVSS

SEQ ID NO: 803 - protein, 29 aa, Oryctolagus cuniculus
QSVEESGGRLVTPGTPLTLTCTVSGFSLS

SEQ ID NO: 804 - protein, 5 aa, Oryctolagus cuniculus
SYAMN

SEQ ID NO: 805 - protein, 14 aa, Oryctolagus cuniculus
WVRQAPGKGLEWIG

SEQ ID NO: 806 - protein, 16 aa, Oryctolagus cuniculus
AIRSSGATFFASWVNG

SEQ ID NO: 807 - protein, 30 aa, Oryctolagus cuniculus
RFTISKTSTTVDLKITSPTPEDTATYFCAR

SEQ ID NO: 808 - protein, 13 aa, Oryctolagus cuniculus
DTNDGWYINRLDL

SEQ ID NO: 809 - protein, 11 aa, Artificial
  Humanized antibody sequence
WGPGTLVTVSS

SEQ ID NO: 810 - protein, 330 aa, Artificial; identical to SEQ ID NO: 10
  Humanized antibody sequence

SEQ ID NO: 811 - DNA, 1344 bp, Artificial
  Humanized antibody sequence
cagtcggtggaggagtccgggggtcgcctggtcacgcctgggacacccctgacactcacctgcacagtctctggattctccctcagtagttatgcaatgaattgggtccgccaggctccagggaaggggctggagtggatcggggccattcgtagtagtggtgccacattcttcgcgagctgggtgaatggccgtttcaccatctccaaaacctcgaccacggtggatctgaaaatcaccagtccgacacccgaggacacggccacctatttctgtgccagagatactaatgatggttggtatattaatcggttggatctctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 812 - DNA, 354 bp, Artificial
  Humanized antibody sequence
cagtcggtggaggagtccgggggtcgcctggtcacgcctgggacacccctgacactcacctgcacagtctctggattctccctcagtagttatgcaatgaattgggtccgccaggctccagggaaggggctggagtggatcggggccattcgtagtagtggtgccacattcttcgcgagctgggtgaatggccgtttcaccatctccaaaacctcgaccacggtggatctgaaaatcaccagtccgacacccgaggacacggccacctatttctgtgccagagatactaatgatggttggtatattaatcggttggatctctggggcccgggcaccctcgtcaccgtctcgagc

SEQ ID NO: 813 - DNA, 87 bp, Oryctolagus cuniculus; identical to SEQ ID NO: 13

SEQ ID NO: 814 - DNA, 15 bp, Oryctolagus cuniculus
agttatgcaatgaat

SEQ ID NO: 815 - DNA, 42 bp, Oryctolagus cuniculus
tgggtccgccaggctccagggaaggggctggagtggatcggg

SEQ ID NO: 816 - DNA, 48 bp, Oryctolagus cuniculus
gccattcgtagtagtggtgccacattcttcgcgagctgggtgaatggc

SEQ ID NO: 817 - DNA, 90 bp, Oryctolagus cuniculus
cgtttcaccatctccaaaacctcgaccacggtggatctgaaaatcaccagtccgacacccgaggacacggccacctatttctgtgccaga

SEQ ID NO: 818 - DNA, 39 bp, Oryctolagus cuniculus
gatactaatgatggttggtatattaatcggttggatctc

SEQ ID NO: 819 - DNA, 33 bp, Artificial; identical to SEQ ID NO: 19
  Humanized antibody sequence

SEQ ID NO: 820 - DNA, 990 bp, Artificial; identical to SEQ ID NO: 20
  Humanized antibody sequence

SEQ ID NO: 821 - protein, 217 aa, Artificial
  Humanized antibody sequence
AAVLTQTPSPVSAAVGGTVSISCQSSKSVYSNYLSWFQQKPGQPPKFLIYKASTLASGVPSRFKGSGSGTQFTLTISDVQCDDAATYYCAGGDTNISDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 110 aa, Artificial
  Humanized antibody sequence
AAVLTQTPSPVSAAVGGTVSISCQSSKSVYSNYLSWFQQKPGQPPKFLIYKASTLASGVPSRFKGSGSGTQFTLTISDVQCDDAATYYCAGGDTNISDNAFGGGTEVVVK

SEQ ID NO: 823 - protein, 23 aa, Oryctolagus cuniculus
AAVLTQTPSPVSAAVGGTVSISC

SEQ ID NO: 824 - protein, 12 aa, Oryctolagus cuniculus
QSSKSVYSNYLS

SEQ ID NO: 825 - protein, 15 aa, Oryctolagus cuniculus
WFQQKPGQPPKFLIY

SEQ ID NO: 826 - protein, 7 aa, Oryctolagus cuniculus
KASTLAS

SEQ ID NO: 827 - protein, 32 aa, Oryctolagus cuniculus
GVPSRFKGSGSGTQFTLTISDVQCDDAATYYC

SEQ ID NO: 828 - protein, 11 aa, Oryctolagus cuniculus
AGGDTNISDNA

SEQ ID NO: 829 - protein, 10 aa, Artificial
  Humanized antibody sequence
FGGGTEVVVK

SEQ ID NO: 830 - protein, 107 aa, Artificial [sequence omitted]

SEQ ID NO: 831 - DNA, 651 bp, Artificial
  Humanized antibody sequence
gccgccgtgctgacccagactccatctcccgtgtctgcagctgtgggaggcacagtcagcatcagttgccagtccagtaagagtgtttatagtaactacttatcctggtttcagcagaaaccagggcagcctcccaagttcctgatctacaaggcatccactctggcatctggggtcccatcgcggttcaaaggcagtggatctgggacacagttcactctcaccatcagcgacgtgcagtgtgacgatgctgccacttactactgtgcaggcggtgatactaatattagtgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 832 - DNA, 330 bp, Artificial
  Humanized antibody sequence
gccgccgtgctgacccagactccatctcccgtgtctgcagctgtgggaggcacagtcagcatcagttgccagtccagtaagagtgtttatagtaactacttatcctggtttcagcagaaaccagggcagcctcccaagttcctgatctacaaggcatccactctggcatctggggtcccatcgcggttcaaaggcagtggatctgggacacagttcactctcaccatcagcgacgtgcagtgtgacgatgctgccacttactactgtgcaggcggtgatactaatattagtgataatgctttcggcggagggaccgaggtggtggtcaaa

SEQ ID NO: 833 - DNA, 69 bp, Oryctolagus cuniculus
gccgccgtgctgacccagactccatctcccgtgtctgcagctgtgggaggcacagtcagcatcagttgc

SEQ ID NO: 834 - DNA, 36 bp, Oryctolagus cuniculus
cagtccagtaagagtgtttatagtaactacttatcc

SEQ ID NO: 835 - DNA, 45 bp, Oryctolagus cuniculus
tggtttcagcagaaaccagggcagcctcccaagttcctgatctac

SEQ ID NO: 836 - DNA, 21 bp, Oryctolagus cuniculus
aaggcatccactctggcatct

SEQ ID NO: 837 - DNA, 96 bp, Oryctolagus cuniculus
ggggtcccatcgcggttcaaaggcagtggatctgggacacagttcactctcaccatcagcgacgtgcagtgtgacgatgctgccacttactactgt

SEQ ID NO: 838 - DNA, 33 bp, Oryctolagus cuniculus
gcaggcggtgatactaatattagtgataatgct

SEQ ID NO: 839 - DNA, 30 bp, Artificial; identical to SEQ ID NO: 39
  Humanized antibody sequence

SEQ ID NO: 840 - DNA, 321 bp, Artificial; identical to SEQ ID NO: 40
  Humanized antibody sequence

SEQ ID NO: 841 - protein, 451 aa, Artificial
  Humanized antibody sequence
EVQLVESGGGLVQPGGSLRLSCAASGFSLSSYAMNWVRQAPGKGLEWIGAIRSSGATFFASSVNGRFTISRDNSKNTVYLQMNSLRAEDTAVYYCARDTNDGWYINRLDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 842 - protein, 121 aa, Artificial
  Humanized antibody sequence
EVQLVESGGGLVQPGGSLRLSCAASGFSLSSYAMNWVRQAPGKGLEWIGAIRSSGATFFASSVNGRFTISRDNSKNTVYLQMNSLRAEDTAVYYCARDTNDGWYINRLDLWGQGTLVTVSS

SEQ ID NO: 843 - protein, 30 aa, Artificial
  Humanized antibody sequence
EVQLVESGGGLVQPGGSLRLSCAASGFSLS

SEQ ID NO: 844 - protein, 5 aa, Oryctolagus cuniculus
SYAMN

SEQ ID NO: 845 - protein, 14 aa, Artificial
  Humanized antibody sequence
WVRQAPGKGLEWIG

SEQ ID NO: 846 - protein, 16 aa, Artificial
  Humanized antibody sequence
AIRSSGATFFASSVNG

SEQ ID NO: 847 - protein, 32 aa, Artificial
  Humanized antibody sequence
RFTISRDNSKNTVYLQMNSLRAEDTAVYYCAR

SEQ ID NO: 848 - protein, 13 aa, Oryctolagus cuniculus
DTNDGWYINRLDL

SEQ ID NO: 849 - protein, 11 aa, Artificial
  Humanized antibody sequence
WGQGTLVTVSS

SEQ ID NO: 850 - protein, 330 aa, Artificial; identical to SEQ ID NO: 690
  Humanized antibody sequence

SEQ ID NO: 851 - DNA, 1353 bp, Artificial
  Humanized antibody sequence
gaggtgcagctggtggagtctgggggaggcttggtccagcctggggggtccctgagactctcctgtgcagcctctggattctccctcagtagttatgcaatgaattgggtccgccaggctccagggaaggggctggagtggatcggggccattcgtagtagtggtgccacattcttcgcgagctccgtgaatggcagattcaccatctccagagacaattccaagaacacggtgtatcttcaaatgaacagcctgagagccgaggacacggctgtgtattactgtgcgagagatactaatgatggttggtatattaatcggttggatctctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 852 - DNA, 363 bp, Artificial
  Humanized antibody sequence
gaggtgcagctggtggagtctgggggaggcttggtccagcctggggggtccctgagactctcctgtgcagcctctggattctccctcagtagttatgcaatgaattgggtccgccaggctccagggaaggggctggagtggatcggggccattcgtagtagtggtgccacattcttcgcgagctccgtgaatggcagattcaccatctccagagacaattccaagaacacggtgtatcttcaaatgaacagcctgagagccgaggacacggctgtgtattactgtgcgagagatactaatgatggttggtatattaatcggttggatctctggggccaagggaccctcgtcaccgtctcgagc

SEQ ID NO: 853 - DNA, 90 bp, Artificial
  Humanized antibody sequence
gaggtgcagctggtggagtctgggggaggcttggtccagcctggggggtccctgagactctcctgtgcagcctctggattctccctcagt

SEQ ID NO: 854 - DNA, 15 bp, Oryctolagus cuniculus
agttatgcaatgaat

SEQ ID NO: 855 - DNA, 42 bp, Artificial; identical to SEQ ID NO: 815
  Humanized antibody sequence

SEQ ID NO: 856 - DNA, 48 bp, Artificial
  Humanized antibody sequence
gccattcgtagtagtggtgccacattcttcgcgagctccgtgaatggc

SEQ ID NO: 857 - DNA, 96 bp, Artificial
  Humanized antibody sequence
agattcaccatctccagagacaattccaagaacacggtgtatcttcaaatgaacagcctgagagccgaggacacggctgtgtattactgtgcgaga

SEQ ID NO: 858 - DNA, 39 bp, Oryctolagus cuniculus; identical to SEQ ID NO: 818

SEQ ID NO: 859 - DNA, 33 bp, Artificial; identical to SEQ ID NO: 259
  Humanized antibody sequence

SEQ ID NO: 860 - DNA, 990 bp, Artificial; identical to SEQ ID NO: 700
  Humanized antibody sequence

SEQ ID NO: 861 - protein, 216 aa, Artificial
  Humanized antibody sequence
AVLTQSPSTLSASVGDRVTITCQSSKSVYSNYLSWFQQKPGKAPKFLIYKASTLASGVPSRFSGSGSGTEFTLTISSLQPDDFATYYCAGGDTNIADNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 109 aa, Artificial
  Humanized antibody sequence
AVLTQSPSTLSASVGDRVTITCQSSKSVYSNYLSWFQQKPGKAPKFLIYKASTLASGVPSRFSGSGSGTEFTLTISSLQPDDFATYYCAGGDTNIADNAFGGGTKVEIK

SEQ ID NO: 863 - protein, 22 aa, Artificial
  Humanized antibody sequence
AVLTQSPSTLSASVGDRVTITC

SEQ ID NO: 864 - protein, 12 aa, Oryctolagus cuniculus
QSSKSVYSNYLS

SEQ ID NO: 865 - protein, 15 aa, Artificial
  Humanized antibody sequence
WFQQKPGKAPKFLIY

SEQ ID NO: 866 - protein, 7 aa, Oryctolagus cuniculus
KASTLAS

SEQ ID NO: 867 - protein, 32 aa, Artificial; identical to SEQ ID NO: 747
  Humanized antibody sequence

SEQ ID NO: 868 - protein, 11 aa, Artificial
  Humanized antibody sequence
AGGDTNIADNA

SEQ ID NO: 869 - protein, 10 aa, Artificial
  Humanized antibody sequence
FGGGTKVEIK

SEQ ID NO: 870 - protein, 107 aa, Artificial [sequence omitted]

SEQ ID NO: 871 - DNA, 648 bp, Artificial
  Humanized antibody sequence
gccgtgctgacccagtctccttccaccctgtctgcatctgtaggagacagagtcaccatcacttgccagtccagtaagagtgtttatagtaactacttatcctggtttcagcagaaaccagggaaagcccctaagttcctgatctataaggcatccactctggcatctggggtcccatcaaggttcagcggcagtggatctgggacagaattcactctcaccatcagcagcctgcagcctgatgattttgcaacttattactgcgcaggcggtgatactaatattgctgataatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 872 - DNA, 327 bp, Artificial
  Humanized antibody sequence
gccgtgctgacccagtctccttccaccctgtctgcatctgtaggagacagagtcaccatcacttgccagtccagtaagagtgtttatagtaactacttatcctggtttcagcagaaaccagggaaagcccctaagttcctgatctataaggcatccactctggcatctggggtcccatcaaggttcagcggcagtggatctgggacagaattcactctcaccatcagcagcctgcagcctgatgattttgcaacttattactgcgcaggcggtgatactaatattgctgataatgctttcggcggaggaaccaaggtggaaatcaaa

SEQ ID NO: 873 - DNA, 66 bp, Artificial
  Humanized antibody sequence
gccgtgctgacccagtctccttccaccctgtctgcatctgtaggagacagagtcaccatcacttgc

SEQ ID NO: 874 - DNA, 36 bp, Oryctolagus cuniculus; identical to SEQ ID NO: 834

SEQ ID NO: 875 - DNA, 45 bp, Artificial
  Humanized antibody sequence
tggtttcagcagaaaccagggaaagcccctaagttcctgatctat

SEQ ID NO: 876 - DNA, 21 bp, Oryctolagus cuniculus
aaggcatccactctggcatct

SEQ ID NO: 877 - DNA, 96 bp, Artificial
  Humanized antibody sequence
ggggtcccatcaaggttcagcggcagtggatctgggacagaattcactctcaccatcagcagcctgcagcctgatgattttgcaacttattactgc

SEQ ID NO: 878 - DNA, 33 bp, Artificial
  Humanized antibody sequence
gcaggcggtgatactaatattgctgataatgct

SEQ ID NO: 879 - DNA, 30 bp, Artificial; identical to SEQ ID NO: 279
  Humanized antibody sequence

SEQ ID NO: 880 - DNA, 321 bp, Artificial; identical to SEQ ID NO: 40
  Humanized antibody sequence

SEQ ID NO: 881 - protein, 453 aa, Artificial
  Humanized antibody sequence
QSLEESGGDLVKPGASLTLTCKASGFSFSSGYYMCWVRQAPGKGLEWIACIYAGSGGSTFFANWAKGRFTISKTSSTTVTLQMTSLTAADTATYFCARDGGYAGYGYAFFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 123 aa, Artificial
  Humanized antibody sequence
QSLEESGGDLVKPGASLTLTCKASGFSFSSGYYMCWVRQAPGKGLEWIACIYAGSGGSTFFANWAKGRFTISKTSSTTVTLQMTSLTAADTATYFCARDGGYAGYGYAFFNLWGPGTLVTVSS

SEQ ID NO: 883 - protein, 29 aa, Oryctolagus cuniculus
QSLEESGGDLVKPGASLTLTCKASGFSFS

SEQ ID NO: 884 - protein, 6 aa, Oryctolagus cuniculus
SGYYMC

SEQ ID NO: 885 - protein, 14 aa, Oryctolagus cuniculus
WVRQAPGKGLEWIA

SEQ ID NO: 886 - protein, 18 aa, Oryctolagus cuniculus
CIYAGSGGSTFFANWAKG

SEQ ID NO: 887 - protein, 31 aa, Oryctolagus cuniculus
RFTISKTSSTTVTLQMTSLTAADTATYFCAR

SEQ ID NO: 888 - protein, 14 aa, Oryctolagus cuniculus
DGGYAGYGYAFFNL

SEQ ID NO: 889 - protein, 11 aa, Artificial
  Humanized antibody sequence
WGPGTLVTVSS

SEQ ID NO: 890 - protein, 330 aa, Artificial; identical to SEQ ID NO: 10
  Humanized antibody sequence

SEQ ID NO: 891 - DNA, 1359 bp, Artificial
  Humanized antibody sequence
cagtcgttggaggagtccgggggagacctggtcaagcctggggcatccctgacactcacctgcaaagcctctggattctccttcagtagcggctactacatgtgctgggtccgccaggctccagggaaggggctggagtggatcgcatgcatttatgctggtagtggtggtagcactttcttcgcgaactgggcgaaaggccgattcaccatctccaaaacctcgtcgaccacggtgactctgcaaatgaccagtctgacagccgcggacacggccacctatttctgtgcgagagatggtggttatgctggctatggttatgctttctttaacttgtggggcccggggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 892 - DNA, 369 bp, Artificial
  Humanized antibody sequence
cagtcgttggaggagtccgggggagacctggtcaagcctggggcatccctgacactcacctgcaaagcctctggattctccttcagtagcggctactacatgtgctgggtccgccaggctccagggaaggggctggagtggatcgcatgcatttatgctggtagtggtggtagcactttcttcgcgaactgggcgaaaggccgattcaccatctccaaaacctcgtcgaccacggtgactctgcaaatgaccagtctgacagccgcggacacggccacctatttctgtgcgagagatggtggttatgctggctatggttatgctttctttaacttgtggggcccggggaccctcgtcaccgtctcgagc

SEQ ID NO: 893 - DNA, 87 bp, Oryctolagus cuniculus
cagtcgttggaggagtccgggggagacctggtcaagcctggggcatccctgacactcacctgcaaagcctctggattctccttcagt

SEQ ID NO: 894 - DNA, 18 bp, Oryctolagus cuniculus
agcggctactacatgtgc

SEQ ID NO: 895 - DNA, 42 bp, Oryctolagus cuniculus; identical to SEQ ID NO: 375

SEQ ID NO: 896 - DNA, 54 bp, Oryctolagus cuniculus
tgcatttatgctggtagtggtggtagcactttcttcgcgaactgggcgaaaggc

SEQ ID NO: 897 - DNA, 93 bp, Oryctolagus cuniculus
cgattcaccatctccaaaacctcgtcgaccacggtgactctgcaaatgaccagtctgacagccgcggacacggccacctatttctgtgcgaga

SEQ ID NO: 898 - DNA, 42 bp, Oryctolagus cuniculus
gatggtggttatgctggctatggttatgctttctttaacttg

SEQ ID NO: 899 - DNA, 33 bp, Artificial; identical to SEQ ID NO: 179
  Humanized antibody sequence

SEQ ID NO: 900 - DNA, 990 bp, Artificial; identical to SEQ ID NO: 20
  Humanized antibody sequence

SEQ ID NO: 901 - protein, 217 aa, Artificial
  Humanized antibody sequence
DVVMTQTPASVSEPVGGTVTIKCQASERIYSGLAWYQQKPGQPPKLLIYGASTLASGVPSRFKGSGSGTDFTLTISDLECDDAAIYYCQCTYYGSSYPNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 902 - protein, 110 aa, Artificial
  Humanized antibody sequence
DVVMTQTPASVSEPVGGTVTIKCQASERIYSGLAWYQQKPGQPPKLLIYGASTLASGVPSRFKGSGSGTDFTLTISDLECDDAAIYYCQCTYYGSSYPNVFGGGTEVVVK

SEQ ID NO: 903 - protein, 23 aa, Oryctolagus cuniculus
DVVMTQTPASVSEPVGGTVTIKC

SEQ ID NO: 904 - protein, 11 aa, Oryctolagus cuniculus
QASERIYSGLA

SEQ ID NO: 905 - protein, 15 aa, Oryctolagus cuniculus
WYQQKPGQPPKLLIY

SEQ ID NO: 906 - protein, 7 aa, Oryctolagus cuniculus
GASTLAS

SEQ ID NO: 907 - protein, 32 aa, Oryctolagus cuniculus
GVPSRFKGSGSGTDFTLTISDLECDDAAIYYC

SEQ ID NO: 908 - protein, 12 aa, Oryctolagus cuniculus
QCTYYGSSYPNV

SEQ ID NO: 909 - protein, 10 aa, Artificial
  Humanized antibody sequence
FGGGTEVVVK

SEQ ID NO: 910 - protein, 107 aa, Artificial [sequence omitted]

SEQ ID NO: 911 - DNA, 651 bp, Artificial
  Humanized antibody sequence
gatgttgtgatgacccagactccagcctccgtgtctgaacctgtgggaggcacagtcaccatcaagtgccaggccagtgagaggatttatagtggtttggcctggtatcagcagaaaccagggcagcctcccaagctcctgatctatggtgcatccactctggcatctggggtcccatcgcggttcaaaggcagtggatctgggacagatttcactctcaccatcagcgacctggagtgtgacgatgctgccatttactactgtcaatgtacttattatggttctagttatcctaatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 912 - DNA, 330 bp, Artificial
  Humanized antibody sequence
gatgttgtgatgacccagactccagcctccgtgtctgaacctgtgggaggcacagtcaccatcaagtgccaggccagtgagaggatttatagtggtttggcctggtatcagcagaaaccagggcagcctcccaagctcctgatctatggtgcatccactctggcatctggggtcccatcgcggttcaaaggcagtggatctgggacagatttcactctcaccatcagcgacctggagtgtgacgatgctgccatttactactgtcaatgtacttattatggttctagttatcctaatgttttcggcggagggaccgaggtggtggtcaaa

SEQ ID NO: 913 - DNA, 69 bp, Oryctolagus cuniculus
gatgttgtgatgacccagactccagcctccgtgtctgaacctgtgggaggcacagtcaccatcaagtgc

SEQ ID NO: 914 - DNA, 33 bp, Oryctolagus cuniculus
caggccagtgagaggatttatagtggtttggcc

SEQ ID NO: 915 - DNA, 45 bp, Oryctolagus cuniculus; identical to SEQ ID NO: 35

SEQ ID NO: 916 - DNA, 21 bp, Oryctolagus cuniculus
ggtgcatccactctggcatct

SEQ ID NO: 917 - DNA, 96 bp, Oryctolagus cuniculus
ggggtcccatcgcggttcaaaggcagtggatctgggacagatttcactctcaccatcagcgacctggagtgtgacgatgctgccatttactactgt

SEQ ID NO: 918 - DNA, 36 bp, Oryctolagus cuniculus
caatgtacttattatggttctagttatcctaatgtt

SEQ ID NO: 919 - DNA, 30 bp, Artificial; identical to SEQ ID NO: 39
  Humanized antibody sequence

SEQ ID NO: 920 - DNA, 321 bp, Artificial; identical to SEQ ID NO: 40
  Humanized antibody sequence

SEQ ID NO: 921 - protein, 453 aa, Artificial; identical to SEQ ID NO: 881
  Humanized antibody sequence

SEQ ID NO: 922 - protein, 123 aa, Artificial; identical to SEQ ID NO: 882
  Humanized antibody sequence

SEQ ID NO: 923 - protein, 29 aa, Artificial
  Humanized antibody sequence
QSLEESGGDLVKPGASLTLTCKASGFSFS

SEQ ID NO: 924 - protein, 6 aa, Oryctolagus cuniculus
SGYYMC

SEQ ID NO: 925 - protein, 14 aa, Artificial
  Humanized antibody sequence
WVRQAPGKGLEWIA

SEQ ID NO: 926 - protein, 18 aa, Oryctolagus cuniculus
CIYAGSGGSTFFANWAKG

SEQ ID NO: 927 - protein, 31 aa, Artificial; identical to SEQ ID NO: 887
  Humanized antibody sequence

SEQ ID NO: 928 - protein, 14 aa, Oryctolagus cuniculus
DGGYAGYGYAFFNL

SEQ ID NO: 929 - protein, 11 aa, Artificial
  Humanized antibody sequence
WGPGTLVTVSS

SEQ ID NO: 930 - protein, 330 aa, Artificial; identical to SEQ ID NO: 10
  Humanized antibody sequence

SEQ ID NO: 931 - DNA, 1359 bp, Artificial; identical to SEQ ID NO: 891
  Humanized antibody sequence

SEQ ID NO: 932 - DNA, 369 bp, Artificial; identical to SEQ ID NO: 892
  Humanized antibody sequence

SEQ ID NO: 933 - DNA, 87 bp, Artificial; identical to SEQ ID NO: 893
  Humanized antibody sequence

SEQ ID NO: 934 - DNA, 18 bp, Oryctolagus cuniculus
agcggctactacatgtgc

SEQ ID NO: 935 - DNA, 42 bp, Artificial; identical to SEQ ID NO: 375
  Humanized antibody sequence

SEQ ID NO: 936 - DNA, 54 bp, Oryctolagus cuniculus; identical to SEQ ID NO: 896

SEQ ID NO: 937 - DNA, 93 bp, Artificial; identical to SEQ ID NO: 897
  Humanized antibody sequence

SEQ ID NO: 938 - DNA, 42 bp, Oryctolagus cuniculus; identical to SEQ ID NO: 898

SEQ ID NO: 939 - DNA, 33 bp, Artificial; identical to SEQ ID NO: 179
  Humanized antibody sequence

SEQ ID NO: 940 - DNA, 990 bp, Artificial; identical to SEQ ID NO: 20
  Humanized antibody sequence

SEQ ID NO: 941 - protein, 217 aa, Artificial
  Humanized antibody sequence
DVVMTQTPASVSEPVGGTVTIKCQASERIYSGLAWYQQKPGQPPKLLIYGASTLASGVPSRFKGSGSGTDFTLTISDLECDDAAIYYCQATYYGSSYPNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 942 - protein, 110 aa, Artificial
  Humanized antibody sequence
DVVMTQTPASVSEPVGGTVTIKCQASERIYSGLAWYQQKPGQPPKLLIYGASTLASGVPSRFKGSGSGTDFTLTISDLECDDAAIYYCQATYYGSSYPNVFGGGTEVVVK

SEQ ID NO: 943 - protein, 23 aa, Artificial
  Humanized antibody sequence
DVVMTQTPASVSEPVGGTVTIKC

SEQ ID NO: 944 - protein, 11 aa, Oryctolagus cuniculus
QASERIYSGLA

SEQ ID NO: 945 - protein, 15 aa, Artificial
  Humanized antibody sequence
WYQQKPGQPPKLLIY

SEQ ID NO: 946 - protein, 7 aa, Oryctolagus cuniculus
GASTLAS

SEQ ID NO: 947 - protein, 32 aa, Artificial; identical to SEQ ID NO: 907
  Humanized antibody sequence

SEQ ID NO: 948 - protein, 12 aa, Artificial
  Humanized antibody sequence
QATYYGSSYPNV

SEQ ID NO: 949 - protein, 10 aa, Artificial
  Humanized antibody sequence
FGGGTEVVVK

SEQ ID NO: 950 - protein, 107 aa, Artificial [sequence omitted]

SEQ ID NO: 951 - DNA, 651 bp, Artificial
  Humanized antibody sequence
gatgttgtgatgacccagactccagcctccgtgtctgaacctgtgggaggcacagtcaccatcaagtgccaggccagtgagaggatttatagtggtttggcctggtatcagcagaaaccagggcagcctcccaagctcctgatctatggtgcatccactctggcatctggggtcccatcgcggttcaaaggcagtggatctgggacagatttcactctcaccatcagcgacctggagtgtgacgatgctgccatttactactgtcaagctacttattatggttctagttatcctaatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 952 - DNA, 330 bp, Artificial
  Humanized antibody sequence
gatgttgtgatgacccagactccagcctccgtgtctgaacctgtgggaggcacagtcaccatcaagtgccaggccagtgagaggatttatagtggtttggcctggtatcagcagaaaccagggcagcctcccaagctcctgatctatggtgcatccactctggcatctggggtcccatcgcggttcaaaggcagtggatctgggacagatttcactctcaccatcagcgacctggagtgtgacgatgctgccatttactactgtcaagctacttattatggttctagttatcctaatgttttcggcggagggaccgaggtggtggtcaaa

SEQ ID NO: 953 - DNA, 69 bp, Artificial; identical to SEQ ID NO: 913
  Humanized antibody sequence

SEQ ID NO: 954 - DNA, 33 bp, Oryctolagus cuniculus; identical to SEQ ID NO: 914

SEQ ID NO: 955 - DNA, 45 bp, Artificial; identical to SEQ ID NO: 35
  Humanized antibody sequence

SEQ ID NO: 956 - DNA, 21 bp, Oryctolagus cuniculus
ggtgcatccactctggcatct

SEQ ID NO: 957 - DNA, 96 bp, Artificial; identical to SEQ ID NO: 917
  Humanized antibody sequence

SEQ ID NO: 958 - DNA, 36 bp, Artificial
  Humanized antibody sequence
caagctacttattatggttctagttatcctaatgtt

SEQ ID NO: 959 - DNA, 30 bp, Artificial; identical to SEQ ID NO: 39
  Humanized antibody sequence

SEQ ID NO: 960 - DNA, 321 bp, Artificial; identical to SEQ ID NO: 40
  Humanized antibody sequence

SEQ ID NO: 961 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 962 - protein, 662 aa, Homo sapiens
QEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 963 - DNA, 25378 bp, Homo sapiens
gtccgatggggctctggtggcgtgatctgcgcgccccaggcgtcaagcacccacaccctagaaggtttccgcagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggtgcgggtgtagggatgggaggccggggcgaacccgcagccgggacggtgcggtgctgtttcctctcgggcctcagtttccccccatgtaagagaggaagtggagtgcaggtcgccgagggctcttcgcttggcacgatcttggggactgcaggcaaggcggcgggggaggacgggtagtggggagcacggtggagagcggggacggccggctctttggggacttgctggggcgtgcggctgcgctattcagtgggaaggttcgcggggttgggagacccggaggccgaggaagggcgagcagagcactgccaggatatcctgcccagatttcccagtttctgcctcgccgcggcacaggtgggtgaaggagtgaatgcctggaacgtactgggaactgcaccaggcacagagaaagcgggcttgccattatagtgggttccgatttggtttggaaaacatgggcagcggagggtggagggcctggagagaaggccctacccgagacaggggcggggtgggaaggacggcagatgctgggagcacgaggcaatttctttatgacacagaactcatgctctagtattccatctgtttcagccgaagaaaagaaccagctgaaggggcaggggagaaggggcggaggtattctcgaggcccattggcgtcctttaggactcaggcagggaagggcccttggtgctctggagccggaggtggtgcgcctggtactgggaccccggagctgagcccggcgcctcagcccacctggctgtctgccgaccgtgtgcggggcgagtttgctcaacaactctgccagcttctggccctcaggctgtgggaagcttcttcccggggcgagaccactagctttttctaagtattaccagcccaggacttggctgaggttctgtgtcccccagcttggagtcagatgtggggttgaatcttggcttcctctcactagctgtggtgcttgacaagtcacttatccttgagcctccattgcctaatctttaaaagggaggtgacaatcgtccctacggctcagtggcagcagatggggagatgaagggaaagttctgttgaccatgagtgaacttacaatgcaagccccggggggatcacttgcagttttgtccctgtctgcagtgtgacctgttggtgacattgtctttgctccaaaccacagctcctggggcagaggggaaaattctgccactcacagctgcctgcccacgcttctgtctgagtgtgctgggtggcaggatggcaagtccttactcagctcagtatagccctcttccttgttccctgagcctttgactttctcgagggatgttgtggggttgtggccaggataagaaagggcatttcaagttaccactgctccaaaacaactgttctggaaatagtgagtaccccatcctgagaggtgagtaagcagaggctgtatgaccacctgaaccaagcccttgaggatgtttcttctctggtggaagtttggaacaggagcctcctcaagttcatttattcattcattcaatggttattttgtgggaatcgaatttagaatgaaaatattttttggcaagcagaaaataatttttagaccaatccttttcttttagtcatgagaaactgaggcccagagagaggaggtcaccccaggtgcattagaactgggtttccagaactgacactccactgcacagagtactctcccaattcattcaatttttatttagcggaaggcattttcagatgggtctttgaagcattagtaggagttcagcgatgatggtgtcatgagaattttattctaggattaggaggtaccatgaacaaagatacagagctgggaaaaccagaggtggaagataaggagcacatgtccacagttctttttcttttttttttgagatggagtttcgctcttgttgcccaggctggagtgcaatggtgcagtctcagctcactgcaacatctgtctcccgggttcaagtggttctcctgcctcagcctcccaagaagctgggattacaggtacctgccaccacgcccggctaatttttgtatttttagtagagaaggggtttcaccacgttggccaggctagtcgcaaactcctgacctcctcagtggatccgaggaggtgatcctcccgcctcagcctcccaaagtgctcgaattacaggtgtgagccaccacgcctggcctccacagttctttatccaccgtctgaaatgtaaaatgttacgaaaaccaaaagttttttttgtgatttatttgatggtagcacctgacgtgaactgacatgagattatttttaatttagttgtgtgaatatgcatattcatatattttgctgcatagattacagtatgcagctccagattcttccaagcagactctgattgcccattactgcctttctaaaatccaaacaagttctgaggttcaaaaccgttttggccctaaggctttgggtaaagggggtggactctgttctactctgactggagtccaagatgcatatatacagagatatgggtgatggggctgcaaggtaggttgaggtaggggccaaggaggagcatggagtttggacttgattcatgaggctgtggggagccagtgaaggttcttaagcaggtatgtctgcctgagagcagttggagcagacaagagctaaaaaccaaacaaatcaccatagatagtggctgctataatttgtttgtcccctccaaatctcatgtggaaatttggtcctcagtgttggaagtggggcctaatgggaggtgtttgggtcatgggggaggaacccctgtgaaaggcttggtgccgtccttgtgataatgagtaagttctcccgctatgatttcccttgaaggctgattattaaaaagagcttggcacctccctctcttctctcttgcttcttctcttgccatgtgattgatctctgcacatgtaggctccccttcaccttctgccatcagtgaaagcagcttaaggccctcaccagaagcagatgctggtgccatgcttcctggagagcttgcagaatcatgagctgaataaatcccttttccttgtaaattactcaccttcaggtattcctttatatagcaacacaaaaggactaagacagtggccttgacttttctctctctttaagaagtgttgcctttgctcacttagtcatcccttctgcctgcatttgtagagcatctggatgggagatttatataaccgtcactcttgactttcccagcaggcctatgtcataggtactgtggtctctacaatacagcagaggtatctgaggctccgagaggttgagtgacttgctcatggctgcacaaccagtaaatattggagctggaattcaggtccacggtttcctggctccaaagcccatgattttttccctcaatttattctgactggggcatgggggagggggtggcctttgggcagggccaccaggagcgaccaggcccgtagagagctgggtgcaggtacagaggaaaacctgttgtcgagtgtggcccgtagttcccatttttgcctgaatggcacatttgaaagtgttatataaccatgtgaataataatagttggcctatatgagttctttaatttgctttttggtccgcatttggtaacttctttatcatctactatactctgttgtgtctcttttgttgtaatttgtaagtaggggtgagataaagtacacctagggtttgctgggtttcttccatgtcatcatgttcctccttgcatggggccaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggtgagccaccctttttgggaatggcacttcctgatagggctgggccactgcatatacactggggactgtgcttagtaggcccattgctgaaaatcagaaggggacagcaagtatgtattgagcacttatcgggtaccaagcacagtaactactggctttctgtatagaattccctttaagcctggccatgccccagtggtacgtctatcttcatttgaaagacgaggagactgaagttcagaggggaccacacagacagctaggggtagagcctggatcaaacccattggtctgcctgccagccattcttgtgccaatgcatctgctgcctacggaaacctgtagggacaaggccctgggatgttcagtggagcctgagtcattttataaaaaagcatgactctagggtccaaaattcctttgaagctgttgctatccagagtgaagtcccttctttaggacagggtggccctcctccctcctggatgtcacatcttcggtggaggggcagaaaggggactgggtattctcctcaccctggccctagtgcttcaaatcttaaaaaaacgtttttatttgtgcttctgcaccaccttctagcccacctcgtttcctggcctctaacttgatgagagcgtgtgtcattttcacactgattctccacatggcaggcggtgcttcttagcctcctgcagacagtgaggccccacggtcttgtccaaggtcacacagcgtgtaatgggcagggtcagagtctggagtctggacctgggtctcctagctgcactgcactgctgccccatgggttaatcagctcagcataccgtggctgaacagctacctcataccaaggcctgtggcgccatgacagggattgacagggtccctgccttggaaacccgtagtctaagtagaggagactgacaagtcaatgccttccatcagtctgctcaacacacgtttaccaagtgcctactgtgtgctgcagaggcgaagatgacacagctcaggcctttcccttgagcttacagttcaggaggagagactgaccagtgactgccagtacagttgactatgggacaatgtgctcagccttggggagagacgaagaaggtacccgtatagcaccagatgacaggcacgagccccacaggccagggcagctgctcagaggagagtaggccaagcagaaggcaaacagaaggctgcaggcatttgccatcgagagctggacttcaaactgggcatcataccagcctgggttcgagtcctgcccagccccttattggctgtctaaccctgagcaaatcccttcacctctctgagcctcattcctctatctgtaaaccagttataataattggaacattcatttaaggactaaatgaggtcgtgaagcattcagcagatgctaggtacggaaactcgctgaagtgggggcaggttaagaagcctctggggatacgaaggcatccagggactagttgtggcaggaggctgttaccacttaggtctgaagggtaaggagagggaatagctttccctctgcccagttggagccggtggcatggaggagaggctgcctgtggggaatcacccgagggttcaccgctgccatgcgcagggagtcaggaggtagggagggagtggggcagatgcacaccatttttttttttttttgagactctgttgcccagactggagtgcagtggtgccatatctgcacctctgcctcccgggttcaagctcactgcaacctctgcctcccgggttcaagcgattctcctgcctcagcctcccgagtagctgggactacaggtgtgtgccaccatgcctggctaatttttgtatttttaatagagatggggtttcaccatgttggccaggctggtctcgaactctcgacctcaggtgatcccccacctcggcctcccaaagtgctgggattacaggcgtgagtcaccgctcccagctgctgatgcactcttgtccttctaactcctgctagtgcctcccattggctgagcccaactggaagctttgcaagggagctggtgctgcagtttgcactgagcaggctggagaaggctggagaatagactaggggacaaaccgaattgccagtgctgttatgtcatgatttaggcatggagtccagggcctgagcttcactccatgtccatcctgcccagagccttggcacagcctggctcccagacaagatgtcaagttcagaatccttcctaaaaggaatcctctatgccagaccgtgttgcagggatatgggagtgctgggctcccagcctgatcaaggagcgagaaaactcaggctcctagtctgtcctccggggcactagcagggacaaggtgggaggctgctgggctgggatgtggggacaggtttgatcaggtaaggccaggctgtggctgtgtttgctgctgtccaaatggcttaagcagagtcccccggcctctctggcttctgcaggccttgaagttgccccatgtcgactacatcgaggaggactcctctgtctttgcccagagcatcccgtggaacctggagcggattacccctccacggtaccgggcggatgaataccagccccccggtaagacccccatctgtgccctgccccaccccatctgagctgaatccatttgctctgccctggcctggcctccctgctggtggtttccacttctcggggggctttgggactcagcacctccactgacccctttttttctgtcccatccccatcccctgcagcccccactgcctgccttcctgttgccccacaaatgcaaaagtcttgccttaaatgatcctcttttccttcttttctcttgttttccttttctcaccatttggaatggcccagcaggctgcacttaccttggaaggagggttcatctgatggtgactctacctagggcccccaggcctctataactcccagtgccctgcagactggaccagatcctttaatgggatagacacaaccctgtctgggatgcctctgcctaccttcctgttttgctgctccacctgcctccagctccgtttggcttcctggggctccctgcctgggccactttgtgtcttccctctaggcctttctttccactgttccctctgcctggtgtggcctggctatggaagggagggaggaggagcggccatggaaaacggtctgcattctagcagggacttgcaggtggcaattcagtcggggaagactctagatgcacctggcctgaggagagaatgaagggttctagttggactgtgttaagtttgaggtgcccatggtgtgaggtctggagctcagcgcagagatgatgcaatgtggtgggtccatgcaacatggtgccaggacgcagagcttggggtgaactcagctttcaccccttaccggttctcgtgggatcttgggaagccactttcttctatgagctttgtcgttcttgtctgtaaaatgggcacataaccctgtccctgtccttctcacaggttgctgtgagactccaatgagttgaaggatgtgcagatgcttttggaagtgaaaagttggggggctactgtgtgactttgcatacacccaaactgtgtgaccttgcatatgtctgagttgctgccattgcaacagatcagagctggtgggctgggtgtggagaaagggtttgtgtgggggacatcctctggcaagggtggcagcagcagaagtgaggggcctggtcggtcatgtgtgctgacccggcctgggcagcctgtggccagggagaggacagctcctctgtaggaagagcctgttcctttccaaccaggtgagacctcttcagtggagccctggagccccctgtactccacatcagtgcctcagggacctcccggagcaggctaatatcagagaccaagagggacactggcagaggatcacagagaccccagtccaggcagggactgagaagatcttgccccctaagttagtttcctagcactgctgtgacaaattaccaccccctcggttggaacaagttgattctctgcagtcctggaggccagaagcctgaatcagtgtcggcaggaccactttctcccggggggctccagggagaagcttctcttgcctcttccgtgtcccaacagcggcagcacaccaatcccagcctctgtcttcacacagccttctctgtgtctctctcctcttcattgtctcataaggacacttgtcattggatttagggcccactggatcctccaggatgatctcatgtggggaaccttaaccacatctgcaaggaccctttttccaaataaggtcacagccacaggttgtgggggttaggatgtgagtgtatctctttggcagccactgttccctcctctcccttgggccagaagcagacgtggggccctttcttccccataggatgcccatggattgccccccttcccgcttcccccgagtgtctgtgggaggtggcaggaatggcaggcaggggtgtggaaccccttctggagtcatatcaagggcttggctggaggaagtcctcctggagctgttgggctggcatggggcaggctggctgggcccagcagcagcttcttcattcatggggaggccacaagcatgggccctagagctggctgccgccctcaaacccagaccctgcactcttaactgtgtgaccttgcatacgtcactcaccctctctgatcttcaggttcctctgcaaaagggaggtaatgataaccctcactctggggggctgtttggagggttaaatcagttattgctgtagcatgcatttctctgtcaggtattgagtgaggtgctgtgattttagccctgcatttttcttttcttaccattcaataataacgttttgagcacccactgtgcgccaggcaccatattaggtgctggggatacaaatgtgaatgaaatgaatgtggtctcttcccccaacagtgtatccagaagattaatccattccttaaacaaatgctacttgacacagattagttctggataggctgagagctctgaaggagtgcaggcagctgcgagcctgtgtatccagcagaaggatcaggaaaggattcctggaggaagcgctgttctagccaagacctacgggggcattattaaccaggcaaaggggacggtgtccaagcagtggaatgaacgtggattgaagctgtgaggcaggagggagtgtggcctgtgcagaagggaccgaggctggtgagaccaggagggcctgggtggcctccaggtcagatgtgaaaggaagaacttggccacagtctgagcttctcaggcgtatggcagggctgcctggtgagagggaatgagctccctgctctggaggtatgcaagcaggactgggctctcacctgccagaggccacagagctttccagaggctggaagaggccactccaaggcctctttgcccctgagagtggtggctcttcttgaggccaccttgccacgctgtcacagggaactagcagcccctgcctcacccgggggtttggaagatagagggaggcctaggaagggccctgtgtctcatccgagctgggcccctttccagcctctcactggaaggaagcccaaggatgttcctgtgggggcttttaccaggcccacctgccctctgctggccatgcttgcagcctcctgaccctgtcccagcaggacagtgggctggtgtgagcgggcaggaaccgcctgcacttagaaggtgtggggctgcctccccgagcttccatctgccgctggggccacaccccaggcccagggatgggaccccacagtggtcacatcatcttgcagcagaacccaggtacagctcctggagcagatggtggtcccaagcacgggtgggaccagaaaggactctcacctgggctaactcagctgcagcctcagttccctcctcacacacgacgaggaacatggactggaagcctgcccagcaggccttctgctcgatgtgcgttgtgtggcttacgtccagggagggaagcagcctctgtgctgtcttctagataagcctgtattccccgggctgtctgccaatgtatccagttgtcccgtcagcctggaagctctgagggaaaaccttgggctgcttcctgagcacctgtatcccctgcagccagcccggggcctctgctaggagcagactgagcatggcttatgggcctggcaccatctggcctctgcccaccttgctggccttgtcttgtgtctgccccttcgacattccatagcccagctcaatatctagtggttcctctagggtggcgagcactgtttggtctccagatgtcttcaggtcggagctcacagcgctctcagccaccccttcccagtgtagcaccgggcacatggtagatgcctattgatgagtgaaagctcctaacacactcagagagcaaggactccgcctcatcccacagcctgggaggagaggcagactgccaaggacctgctcagcatgctacagaagaaaccaaagtgcccacgggactgatcagtggagcttcctgccgagactggaggccttagggcagggtagacagtgtgtgtgcaggctggggactcacagttcggactgtgcccagacctactagcatagtgggtgggtgggaggatgcgggactgggggccgaccttgcctgaaattcatgtgggatctcagagcagccactgaattgctctgtagggggctaaatagtggcccccacagatacacacacccagacagagcctgtgagccagaccttatttggagaaaaggtctttgtagatgtaattaagcatctcaagatggcatcatctggattatgcggtgggctgtaagtcctgtgatgtgtctttatgagagaaaggcagagggagatttgacacacacaggaggggccacgtggagacagaggtggagattggagaaatgtggccacaagccagggaacaccagcagccaccagaagccggaagacgtgaggcagggttcttcccagagccttcgctgctgagtctgggaatttgtgaccgaagccataagaagtgggtacacgccctgagcctcccacacttgctcacctgtcctgagatgagaatctctactctgcagcatatttggaggatcactgcgggggccacagaggtgctgttcagatggcacttcagaagactcaggagaccctggggcaggagcagtttgactgacagcccagagggctgccctctgattccacctgaggccctgcttttcctggctgcaggggttccagggccaggccatttccgctggcgcaggactctgctagcagcaacctgcctgaagtcttcctttggcctggctgagagtttctgagacctgcgctggagcggaggtgcttccttccttgcttcctttcttcctctctcccttctccatccagcaggctggacctgcctggcatctgtgagctctccctactttctcctataccctaacctttgtcctgcatgggcgactcccccagtgagtctcttgcagcttttaccccagtgcctgcttcttggagaatccaaactgatccagttagggatgataaagtgtagggtaggcgctcggtgactgttttctctgaggttgtgactcgtgtgaggcagaagcagtccccgtgagccctcctggtatcttgtggagtggagaacgcttggacctggagccaggaggcccagacatacatcctgtccgagctgcagcttcctgtctctaaaatgagccggccagcgcaggtggccagacatcactgttattctcctttgagtctttaaatcttgttgtctttcttgcagactcggtgagctgtgaaaggctataataggggctttattttacactttgatactattttttgaacattcatattattgttagatattgatattcatatgaaggagcaggatgacttgggtccttcttggcagtagcattgccagctgatggccttggacagttacctgccctctctaggcctccctttccttgtctatgaaatacattatagaataggatgtagtgtgtgaggattttttggaggttaaacgagtgaatatatttaaggcgctttcaccagtgcctgggatgtgctctgtagtttctgtgtgttaactataaggttgactttatgctcattccctcctctcccacaaatgtcgccttggaaagacggaggcagcctggtggaggtgtatctcctagacaccagcatacagagtgaccaccgggaaatcgagggcagggtcatggtcaccgacttcgagaatgtgcccgaggaggacgggacccgcttccacagacaggtaagcacggccgtctgatgggagggctgcctctgcccatatccccatcctggaggtgggtggggactgccaccccagagcgttgcagctgtactcctgggttgcaccccccccagctgtcactgtcccctccctgccatcagttgtgggaagggcgttcatccatccagccacctgctgatttgttatagggtggagggggggtctttctcatgtggtccttgtgttcgtcgagcaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggtaagtgatggccccagacgctggtctctctccatctggacctggcctgggaggtggcttgggctgggcccagggagagctaatgtctcctaaccaagaatgctgtggcagcctctgccgcagagccagagaaccagagtgccaaggctggcagggttcccagtggccacgagtgcagatgaagaaacccaggccccaagagggtcatgcaggtagcccagggagttcagccttgaccctgggtcaatgacctttccacagttccacactgctccccttttaaaatccggtgatgtctttatgtcttttgttatgttatcttcaatgtggagggactcgaggtgatctaagcaaactttttctatcttctgcttgcatacctctgagaccaggggactcactcacttgcatgactgggccctgcaggtcacactggccaggcagatgtggtggaggaactggcagaggactttttctagactgtgactacatttagtccacccagcggcccccctatgaagtccagttgagaactaggactctgggggccggtggacagagaagagggagggttctctcccttactgacttccttctgtggccagacattgagcaaggcctctgtacagcatgtcctggggctggccttgccgtagctgctaaatagttgacgaaaccagtccagagaggggaggtgactgccagggtcgcacagctcaagctggggaactcgctgggaaaactgtcagctctgggcagcagcttgacttccactgtaagccccagcccccagggtcaaacactggctctggtgctggcagaggcagcccactagcctgtttcaaaggctgagaaggcccaggagtctgccctgtgctccaccagttctgccctgagactttcctacagagtacaggttttgatgttcagttttaaaggcaagaatcaataaccttctgccccatcaggtgaccccttgtgcctgtcccacccctttattgactgacctcggctcagtcaggtcagttcctgaaggtcagtgtgtggaggggaggctgttctttcccagaaaggccttccccaggcctggtgctctggcctctggaggacttcctggagaagtcccttctttggggtcccagtcagtgtatgggaagcccttattgcatgacctggcacggggcaggggctcaacagtcactattgccttccttgccactgccatttcctcctctgtaagcaggtgattgtgtgtccagtctgagcacagagataagcacacagcaggtgcttaataactagcagctgtaggctgggcgcggtggctcatgcctgtaatcccagcactttgggaggccgaggtgggcagatcacctgaggtcaggagttcgagaccagcctgttcaacatggtgaaaccccgtctctactaaaaatacaaaaattagccaggcatggtggtgggtgtctgtatcccagctacttgggaggctaaggcaggagaatcgcttgaacccaggaggtggaggttgcagtgagctgagatcgtgccactgcaatccagcctgagtgatagagcgagattccatctcaaaaataaataagtaaataactagcagctgtaaatgtggctgttgttcttcacctccacactcagtgccactccactccctccctccgtggtgtgaggggcctcactagctgtctcctaggaggagcatggctgtgagattccagctccatccttggccacggctcctggagacatcttagaggccaggatccagaaggctcccacacctcatttgacaggggagaagctgtcagttccaggtccccttgcacatcagggccagagctgcgttaggcctccagtctccaggccactgggccagagctcacaggctggcagagggttagaactgttactggtggctgggtgcagtggctcacgcctgtaatcttagcactttgggagggcaaggcgggaggatcatgaggtcaggacatcgagaccatccttgctaacacggtgaagccccgtctctactaaaactacaaaaaattagccgggcgtggtggcaggcgcctgtagtcccagctactcaggaggctgaggcaggagaatggcgtgaacccgggaggcggagcttgcagtgagccgagattgcgccactgcactccagcctgggcaatagagcgagactccgtctggaaagaaaaaaaaaaaaaagagctgttactgttgacagtagcatgaggtagaccatggcctgcaccaaaatgggggagtggagtgccactgaggccagaaggaaccacaccctcaagggtggggagttatggtatggggggtcctaggcatggagtcttttaattctttagacaatcctgggagcaactgtccctgtttcacagagggcggggccacacagctggtgagtgggcagccaagactctgttcaagtttgtgtgggtccaacacttgcggccacggtggaggggcatctgagccaggcctcagagagtggcgggggaagttgggtggggaagtgtgcccttctcattcctctgaggctcatcctcttggtgcctctctttcatggaaagggataataaggttattgtgaggatcccctgagttcgtatattcagacgcttagacagagccaggcacagagaagggcccggggttggctagtttgattgctggtgtaattgctaatatcttccagtttgtattggtcaaggttctgcagagaagcagaaccagtaggatgtatatattaagagtttcaagctcatgtgaccgtgcgggctggcaagtctgaaatccgcagggcaggccaggcaggctggcaattcctgcagaatttgatgttgcaatactgagtcctaaggcagtcctggggcagaattccttcttccctgggaggcctcagtctgttctcttaaggccttcaactgattaaatgaggcctgcccaagttatagagagtaacctgccttactccgtcttctgatttaaatgttagtcacatctaaaaaatattttcgcagcagcatttccactggcttttgaccaaacatcaggccacaaagttgatccccaaaattaaccatcactctgtgcctgtaagggaggggctgggaaaggggagcaggtctccccaaggggtgaccttggctttgttcctcccaggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtaggtgctggggctgctgccccaaggcgcgggtagggggcggagggcggagggcggagggagggcgggcgggcaggcgggcttcttgtggcacgtgggcttcttgtggcacgttcctggaggccgaacccttctggctttggaaggagtcgtcagagacccccgccatgcgggaggctggggaggaaggggctcgaaacctccatcatcgcagagtctgaatagcagtggccccgccatgcgcccacgtagcggcgcctacgtagccacgcccccacaccccgtcctggccactctccctcctgaaggtcttctggtacccgccccctccccatctccatccccaggccctgcgtcctctgcccaatactctttgggcctccctgttgtccagctctctccgcggctccatgactgacaacttgagcaaggctaatgtgaatgggagcggttgagggctcagacctctcacccgaggaacatccacagagtgtgccgcatgcccggtgcagtgtggctgcggggacacagacacggagcctcggccctgaggagctggggggcagtgaccgtccctcctctgacccaccactcctccagtgtcaggacactgcgggtatctaggggaaggaatcttgttccacttcaagtctggaacttcaagtctgtgtgtgtgcgtgcgcgcgcgcgcgttgggggtgggggttgcagagcagatgcgtacctgacagcggtaacctaggtcccccctggcctatcaaggcttccctggcggccgaatttaaaggcatcaagcaaacaaagcccaacacatctctgccttgtcctctcagtttccccccgtggcacttagaaccacttgatacaccgaatagtttcctatctcccccactaggatgtaaactccacaggggcattgggaatgctgcctggctatggtagggacagaggggagcaccagggcggggcaggggtgccagagttctgcctgggcagtcagattttccttaggaggggacatttgagtgggacccaaacaggtgtatagcagttgtccagcccagctggcaaggcctgagtctgcctctgcaacccctctcttgggctcctttctctgccacccacctcctcacctttccaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggtaagtcaccaccccactgcctcggccaccgtgatgctaacagcccctttggcagtcagggtctgtgccgggacctccagtgccaggctctgtgcagggggaccagagatgaagtaggcctgatggtgccttcaaggacactcagtctgatgagggaggcgagtgcacagaggaaacacgaggtcagggctgtattagagggagcccagaggaggcacctgcccagcccgagggtcagagaaggcatcttggaggagggacatttgatcgggagcttgatggatgaataggagttcacctggccgataagacagcaactaccaaggcttagaggtgtgagaggaggctgtcttacctcactgagtaaggactgcaggcggcttaccttcgagaagagagcttagtgtctgtgtgcacgtgtgtttgtgtgtatgtgtgtgcgtgtgtgcactggcaggagtcccctgctggggcaggagggccgggccatcaccatctttcaccattcacccctgcaccaggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggtaagcaggatggcagggtgggcaagtccaggctggggcttgggaggtctgtgtgaccttgacagtctctcccttctcccttgtctgtgtaaggaggatgacgccaccttaaataggattaaatgagaatggggctctgaaagggctgtgcaatattttcataacgtgtttttatagagacagttgagtatgttctttaagccctcctctctcctaccatgaactaaagatttctgtggaggtcccctcactcccagcaccccctcctcatcccaggccctttttgcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggtgactgtacccctccttcgtgtgtgtgtgtgtgtgtgtgtgtgtgtgtgtgtgtgtgtgtgtgtgtgtgtcagtgctgggccctcagggacccccagcaagcccctccatcctccagactccagctcttctgtaagcttacagggctggccagaccaggagtggggcactcctcacttcacgcggctgggggctgctggagagagccacagcgggaagggtttcctagaggctgcaggacagtgctggatggattttcaatgctcacctgggtgtgagcgtgcggcagggccgcgtgagggtcagcgatctgctactctggactcagccatctctaggcccctctcactcaggtgctccatggttctgggagctgagaaatctcaaaccagcaaaaaagtggaattgatgttgatgctacaggatagtgcacagatgccatctggttgcagcattttggtggaagggcagtgcccagctaggagagtgaggaggggcaggcatttctggcttgaggagatggggtcttaatgctcgtgtgagaggcagagtgggtggagtggagctggctggatccttgctttggcctcctggatttctctctatctccattttgaaaccactctgtgtttggaagaacttttgagtattcagagctgcccactggcagaacagtcttccttgggcaggagtgagctccttgtccccagaaggctgggtctggctggcccctggcagggacactgatgagggtgcttgagttgatcctgtctagtccctttctgtgttttcaaagcccattctaaagcagattcccatttccgtctttgactctaaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggtaggaggctgggcttgccctggggtgaggaggggtctctttctccttatgcacccactgcccgcgaggcttggtcctcacaagtgtgatccatgagactcaagcctgacttgcagttccatactctggttctgccacttccatgccctttgagcctgggcaggtgaccttacttctcctcatctcagcttcctcctccataagagggaaaaaggtattacctgcctcattgtgttgcaaggagatgggcagcatctagggcactggcctggagtatcgcaggtgctttgcctaaggtggtgcagtccaggagaggcagctccagagagaggcccccggctggggctgaaaggagggcagacctcggtttgaatttcaccctgccgctctatagctgtgtgacttgggcaaattacttaacatctctgtatgaggaaatgatgagtgctaagcacttagcttagtgccgggacaatataaattctagctatcgttactattgttttcatcacccgttgctttaaaatccagcctctggtataggcaactattgacgggctaccctgtgtcgaaaacatgcccaggcaggtagcaggaagtcacagatggggacctcttggggcatcaagggatggtgccctgaggctgagctgttctggttgggtggagcatgagaggtctgggaagacagtgggactccagcctggaataagaggctcagagttgattctcgtctgagcacgtccaggggaaccactgagggtttgggaacaggagagtgagggtgagaacctggttctgggcacagcaggctggcatgtaggatggatgttcaggaaagatgagcatagtcaggtggctggtgcccttgtccaggggagaggctccgtcaggttcaggggtcctggcttggagggaagtccgccatgctctaatcacgctcccctttggaagtgctcagccgatgagctcacaggcacatgtcagtttgaagtcatggaatctgactccatgaagcgcacctcaaagagcaccattttgcagctaagggaactgcaggctggacatgctgagtggctgccccgagcccttgcagctaggacatagagaatgctagtaaccacaaccctaccatgttcagagcacatgccaggctccatgctggggcttcgcacgtgtcatcttcacagtgtccctgtgagtaggtgtggtttctctttccatcttacaaatgagtaaacagagcctcagtgtagctaagtaaccactattttaggtttcttagccaatgggtgtgtctgactcctaagcccatggagggcattctgaggtggttcagacagaccccggcttacccttgaacttctgcctgctggctgcatagggaggggctggggggagtttgagcatctcaggccatagagcccctgcctcactgtctccatctctgggtggaaagatggtgttttccctgagaaactaaggctcagagaggttgaatggctctcccaaggtcacacagctggtcagctgcagagttgagaacacaggagtcctggtgctcaggccagcatctctttttttctttgagttgtttctaggtttcctagctcttgcctcagaccttaaagagagagggtctgatggggatgggcactggagacggagcatcccagcatttcacatctgagctggctttcctctgccccaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaagaggcccgtgaggccgggtgggtggggtgctgcgtgtctctcctgcacagcttttctgtgtcagtttgtgccaccaccataccgccatgcatcagggtggcggtttgccaggtagatgctgtgggcagcttccgccattgtgtggacagcatgtatatgtgtctctgtgtggctgggtctgtttttgcttttgtccagatcagtaaggtttgctacctgggtaccccactccacttggagtagaatgtgcataaatatggcataaagaaatgcaatatgcatgcatttattgattgatctatttttttctgagatggggtcttgctgtgttgcccaggctggtctcaaattcctgggctcaagcaatcctctggtctcagcctccccaagtgttgggattataggcatgagccgctgcacctggcctctctgatctatttaacaaacctgctgggagggtctcagggtcaggagcagcactgggctctgaggacacagagctcactcagccgtgacccagagggggtgcctgagctgcatgctgaaggttgttagcatgaccagcaaggcaagaaaaggccctgccgagattagcaaggcatgtgccaagccctggaatgtgacagccgggccttctagaaacctgagtgtataactctccttaaaagccagtaggagctcctcaaaaggcagccctaaggagtccactcttaaatgaactcagagtcagttttaaaatgcaagtctgtgttgattctggtctggatggtgcattcctcgagagcaaaagacagtcttggtcttggatccacttgccctgggtacactgagggctgctaggttccaggtgctcttcctggcactggggagggatacaggcccaagagacatgctgttctccctcctggagcatctattttagtggaggaagacagaaaacaaaccattaatatagagtactgaaaagatgcgatggagaaaactatagcaaggaagggaatggggtgggagagaggtcaggagaggtctcgctgacaaggtggacgaaacaggccatgaggcagagaacatgttccaggcaaagcaaaggcccccaggtggggatgtgcagggagtaccaggaaaccagagaggtgggaatagttatgagatggggggtgcctcagaggggacagggccaagtcaggtgagacctgagggtcacagtcagcagtgagctggggccatgcaggggtctggcctcagaggagtgtggtctggcctggatctgaacctctcactgtggcctagctgctgagctgagaagagatgacaaggaccttgggcagaagcagggagactggagggaggcggtggagggtccaggcgttggggcggggctcaggctggagtctgaagggagcctgcaggcctggtgggtggatgtgggtgggagagggggaggatggcaccaaggctcgggcccctggacagatggagttgccattaagtgggatggggcaggctatggggccatcagtttcagagggatgagtttggcactggcatggtaggcatctgtctatctccacggccctcaaaccaggcatgaagcaggagctcacgtgtttggtcagccatggtgcagaaccgcctgggtgggaggtgcggggtgggagatacacggttgtgtcccaaatgggctctgagccagcgagggccgtctgcactttggcctcacagaaggatgtcggagggagaaatgaagtgtgggtgggggtcccgggccacgctagacatgtgctttcttttcctcgggctctggcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaac

What is claimed is:

1. An isolated antibody or antigen-binding fragment thereof that binds to proprotein convertase subtilisin/kexin type 9 (PCSK9), comprising a heavy chain and a light chain that each comprise complementarity determining regions (CDRs), wherein:
   (a) the variable heavy chain comprises the CDR1 sequence of SEQ ID NO: 4, the CDR2 sequence of SEQ ID NO: 6, and the CDR3 sequence of SEQ ID NO: 8; and the variable light chain comprises the CDR1 sequence of SEQ ID NO: 24, the CDR2 sequence of SEQ ID NO: 26, and the CDR3 sequence of SEQ ID NO: 28; or
   (b) the variable heavy chain comprises the CDR1 sequence of SEQ ID NO: 684, the CDR2 sequence of SEQ ID NO: 686, and the CDR3 sequence of SEQ ID NO: 688; and the variable light chain comprises the CDR1 sequence of SEQ ID NO: 704, the CDR2 sequence of SEQ ID NO: 706, and the CDR3 sequence of SEQ ID NO: 708; or
   (c) the variable heavy chain comprises the CDR1 sequence of SEQ ID NO: 724, the CDR2 sequence of SEQ ID NO: 726, and the CDR3 sequence of SEQ ID NO: 728; and the variable light chain comprises the CDR1 sequence of SEQ ID NO: 744, the CDR2 sequence of SEQ ID NO: 746, and the CDR3 sequence of SEQ ID NO: 748; or
   (d) the variable heavy chain comprises the CDR1 sequence of SEQ ID NO: 764, the CDR2 sequence of SEQ ID NO: 766, and the CDR3 sequence of SEQ ID NO: 768; and the variable light chain comprises the CDR1 sequence of SEQ ID NO: 784, the CDR2 sequence of SEQ ID NO: 786, and the CDR3 sequence of SEQ ID NO: 788; or
   (e) the variable heavy chain comprises the CDR1 sequence of SEQ ID NO: 844, the CDR2 sequence of SEQ ID NO: 846, and the CDR3 sequence of SEQ ID NO: 848; and the variable light chain comprises the CDR1 sequence of SEQ ID NO: 864, the CDR2 sequence of SEQ ID NO: 866, and the CDR3 sequence of SEQ ID NO: 868.

2. The antibody or antigen-binding fragment thereof of claim 1, wherein:
   (i) the variable heavy chain comprises a sequence at least 90% identical to SEQ ID NO: 2, the variable light chain comprises a sequence at least 90% identical to SEQ ID NO: 22, and the variable heavy and light chains comprise the CDRs according to (a); or
   (ii) the variable heavy chain comprises a sequence at least 90% identical to SEQ ID NO: 682, the variable light chain comprises a sequence at least 90% identical to SEQ ID NO: 702, and the variable heavy and light chains comprise the CDRs according to (b); or
   (iii) the variable heavy chain comprises a sequence at least 90% identical to SEQ ID NO: 722, the variable light chain comprises a sequence at least 90% identical to SEQ ID NO: 742, and the variable heavy and light chains comprise the CDRs according to (c); or
   (iv) the variable heavy chain comprises a sequence at least 90% identical to SEQ ID NO: 762, the variable light chain comprises a sequence at least 90% identical to SEQ ID NO: 782, and the variable heavy and light chains comprise the CDRs according to (d); or
   (v) the variable heavy chain comprises a sequence at least 90% identical to SEQ ID NO: 842, the variable light chain comprises a sequence at least 90% identical to SEQ ID NO: 862, and the variable heavy and light chains comprise the CDRs according to (e).

3. The antibody or antigen-binding fragment thereof of claim 1, wherein:
   (i) the variable heavy chain comprises a sequence at least 95% identical to SEQ ID NO: 2, the variable light chain comprises a sequence at least 95% identical to SEQ ID NO: 22, and the variable heavy and light chains comprise the CDRs according to (a); or
   (ii) the variable heavy chain comprises a sequence at least 95% identical to SEQ ID NO: 682, the variable light chain comprises a sequence at least 95% identical to SEQ ID NO: 702, and the variable heavy and light chains comprise the CDRs according to (b); or
   (iii) the variable heavy chain comprises a sequence at least 95% identical to SEQ ID NO: 722, the variable light chain comprises a sequence at least 95% identical to SEQ ID NO: 742, and the variable heavy and light chains comprise the CDRs according to (c); or (iv) the variable heavy chain comprises a sequence at least 95% identical to SEQ ID NO: 762, the variable light chain comprises a sequence at least 95% identical to SEQ ID NO: 782, and the variable heavy and light chains comprise the CDRs according to (d); or (v) the variable heavy chain comprises a sequence at least 95% identical to SEQ ID NO: 842, the variable light chain comprises a sequence at least 95% identical to SEQ ID NO: 862, and the variable heavy and light chains comprise the CDRs according to (e).

4. The antibody or antigen-binding fragment thereof of claim 1, wherein:

(i) the variable heavy chain comprises SEQ ID NO: 2, the variable light chain comprises SEQ ID NO: 22, and the variable heavy and light chains comprise the CDRs according to (a); or (ii) the variable heavy chain comprises SEQ ID NO: 682, the variable light chain comprises SEQ ID NO: 702, and the variable heavy and light chains comprise the CDRs according to (b); or (iii) the variable heavy chain comprises SEQ ID NO: 722, the variable light chain comprises SEQ ID NO: 742, and the variable heavy and light chains comprise the CDRs according to (c); or (iv) the variable heavy chain comprises SEQ ID NO: 762, the variable light chain comprises SEQ ID NO: 782, and the variable heavy and light chains comprise the CDRs according to (d); or (v) the variable heavy chain comprises SEQ ID NO: 842, the variable light chain comprises SEQ ID NO: 862, and the variable heavy and light chains comprise the CDRs according to (e).

5. The antibody or antigen-binding fragment thereof of claim 1, which is selected from the group consisting of chimeric, humanized, and human antibodies or antibody fragments, and scFvs, Fab fragments, Fab' fragments, monovalent antibody fragments, and F(ab')2 fragments.

6. The antibody or antigen-binding fragment thereof of claim 1, which lacks N-glycosylation and/or O-glycosylation.

7. The antibody or antigen-binding fragment thereof of claim 1, which comprises a human constant domain.

8. The antibody or antigen-binding fragment thereof of claim 7, wherein said human constant domain comprises an IgG1, IgG2, IgG3, or IgG4 constant domain.

9. The antibody or antigen-binding fragment thereof of claim 1, which comprises an Fc region that has been modified to alter at least one of effector function, half-life, proteolysis, or glycosylation.

10. The antibody or antigen-binding fragment thereof of claim 9, wherein the Fc region contains one or more mutations that alters or eliminates N- and/or O-glycosylation.

11. The antibody or antigen-binding fragment thereof of claim 1, wherein the antibody or antigen-binding fragment thereof is humanized.

12. The antibody or antigen-binding fragment thereof of claim 1, which when administered to a human subject inhibits or neutralizes at least one biological effect elicited by PCSK9.

13. The antibody or antigen-binding fragment thereof of claim 1, which, when administered to a human subject, reduces serum cholesterol and/or inhibits the binding of PCSK9 to LDLR.

14. The antibody or antigen-binding fragment thereof of claim 1, which binds to human PCSK9 with a $K_D$ that is less than about 100 nM.

15. The antibody or antigen-binding fragment thereof of claim 1, wherein the antibody or antigen-binding fragment thereof is attached to one or more detectable moieties.

16. The antibody or antigen-binding fragment thereof of claim 15, wherein the detectable moiety comprises a fluorescent dye, enzyme, substrate, bioluminescent material, radioactive material, chemiluminescent moiety, or mixtures thereof.

17. A pharmaceutical composition comprising at least one antibody or antigen-binding fragment thereof according to claim 1 and a pharmaceutically acceptable diluent, carrier, solubilizer, emulsifier, preservative, or mixture thereof.

18. The pharmaceutical composition of claim 17, further comprising another active agent.

19. The pharmaceutical composition of claim 17, wherein the other active agent is selected from the group consisting of the following: statins, ACE inhibitors, angiotensin II receptor blockers (ARBs), antiarrhythmics, antiplatelet drugs, aspirin, beta blockers, amiodarone, digoxin, aspirin, anti-clotting agents, digoxin, diuretics, heart failure drugs, vasodilators, blood thinners, anti-cholesterol drugs, cholestyramine, gemfibrozil, omega-3 polyunsaturated fatty acids, pantethine, anti-hypertensives, antidiabetogenic drugs, meglitinides, sulfonylurea, and thiazolidinediones.

20. The pharmaceutical composition of claim 19, which is lyophilized, stabilized and/or or formulated for administration by injection.

* * * * *